United States Patent 12,642,819 (COMPOSITIONS AND METHODS FOR TREATING INFLAMMATORY BOWEL DISEASE) - sequence listing, part 89

SEQ ID NO: 45 - DNA, 3334864 bp, Eubacterium rectale (residues 1-1,667,432 of 3,334,864)
  modified_base (1714618)..(1714712): a, c, t, g, unknown or other
  modified_base (1910018)..(1910116): a, c, t, g, unknown or other
  modified_base (1970512)..(1970607): a, c, t, g, unknown or other
  modified_base (3017846)..(3017940): a, c, t, g, unknown or other
  modified_base (3148068)..(3148163): a, c, t, g, unknown or other
ctctgcgagatcctgcacgtgagcggttggctcaaaatgcttgctcttagccagctcatcccttgcatcctttctgagccactcgaagaaggcgataagtcggttgttcataaacttagctttcttagaagcaccgagatagtcagccttgaaattcgtgttgtagcagcagtagagtaagaaatcagtcagatcaggcactacagcctcggctccttcagcttcgagcaggtcaaccacatagttgtttgctgcaggcaggaatttgacgagaatctcaccgaccacgccgacacgcggcttaacctcatctgtcataggcagattgtcgaaatcccttatgatttcgcggcacatctttttgtatttcttgtgagagagcatttttgtgttgccgacaaagtcgatgactctctttttccacttctcatggagtgcattggcacttcccggctctttctcataaggacgtaccctgtagagacagcgcataaagatatcgccaaactcaagtgcatacagtccgtgctggatgaggcttggagtaaacttaaagcccgggttcttctcgagaccaaccatgttgattgagataacaggcacatcaggatatccggccttttcaagggctcttcggataaagccgatgtagtttgtcgcacggcatccgccaccggtctgtgagatgaggatggctgtgtgtgtcatatcatagttgcctgatttgacagctgccataatctgtcccacgacaatgagtgaagggtagcaggcgtcgttgtttacgaacttaagtcccacgtccacacattcccttgcagggatatccggtatgaccatattgtaaccggctgccttaaaggccggcacgagaaggtcaaagtgtataggtgacatctgagggcaaatgatggtgtagttgtcctttttcatctgctcggtgaatacaacacgctcgtagttagacggctttaattcacgcttttcatgcttggtttccttgactcttatggcggcaaggagcgagcggatacggattcttgctgcgcccaggttgtttacctcgtcaatcttcaggcaggtgtatatcttgcctgagcctgtcagtatatcgtttacgcagtcggttgtgacagcatcgagaccgcagccaaacgagttgagctggattaagtcaaggtcatcacgggtctttacaaagttggctgctgagtacagtctggtgtggtacatccactgatccatgacgatgagaggtctctcaagctcgcccagatgggatactgagtcctctgtcagcacacagatgccatagcttgtgatgagctcagggataccgtggttgatttccgggtccacatggtacggacggcctgcgagcacgattccgcgacgtccggtgtcctccatgtagtcgagcacttcctcgccctttcgctgtatctcaagccttgtcattgcaagctccttccagcctgcggctactgcatcacgaatctgtgactcaggcagattgaaatcgccctttgagaaggtggctacgagctgctgtgagatagtttcctcactctcaaatgacataaacggatttatgaatttaacctcgcctgatgtaatctcgtccacgttgtttttgatattctcagagtatgatgtgacaatagggcagttgtagtgattgtttgcatcgggaaactccttgcgctcatatggcactgccgggtagaaaataaaatctacattttgttttatgagccagcttatatgaccatgtgtgagctttgcagggtagcactctgattcacttgggatagagtcgatacccatctcataaatctttctggtagactgtggtgacagcactacagaaaagccgagacgtttgaaaaatgtagcccagaacggatagttctcgtacatattcaaggctcttgggatgccgactgtaccgtgtggagcatcctttgggtcaagtggctcgtagtcaaatatacgcttgttcttgtattcaaaaagatttgggatgttatccttgttcttctccttgcccagacccttttcacatcggtttccggtgatgtactgtctgttgtcggaaaatttgtttatagtcagaagacagtggtttgtacagccctgacagcgtgcgagctttgtggtgtaggtgagctcgtttatttggtcgatggtgagcattgttgtcttgtaatcagcctcatggcgctcgcgtgcgatgagtgcggcaccaaaggcacccatgatacctgcgatatcaggccttgtggcatgtacacctgcaattttttcaaagcttctaagaacggcatcattgtagaaggtaccgccctggactacgatattttcaccgaggtcgcttgcatcagaaagcttgataaccttgaaaagtgcattctttattactgagtaggcaagtcctgctgatatatctgcgacagatgcgccctccttttgggcctgctttacctttgagttcatgaaaaccgtacatctggttccgaggtcgataggattctttgcaaaaagggcttcctttgcgaaatcctgaactgagtagtttaaggactttgcgaaggtctcaataaatgagccgcagcctgaagagcaggcctcgttgagctgtactgagtcgactgtctggttctttatcttgatgcacttcatgtcctgtccaccgatatcgaggatacagtctacctttgggtcgaagaatgctgctgcgtagtagtgggctacagtctcaacttcgccatcgtccaattttaaagctgcctttaataaagcctctccgtagcctgtagagcaggagtgtacgatgtgtgcatcctcaggtagctttgagtaaatctcctggatggagcggatggctgtcgcgagagggcttccgttgttgttgctgtagaatgagtataaaaggtctccgtcctcgcttacgagagcgattttggtggtggttgagcctgcatctattccgagatagcagttgcccttgtatgtagaaaggtcaccggtctttacgtggttgttgccgtgacgcgctgtaaattcatcgtaatcagcctgatccttaaaaagaggttccatacgtgccacctcaaattccatctttatgccgtttgagaggcggtcgattaaggatgagagtgtggtgacagagttgtctttatagtttaatgcagagcctattgctgcaaacagatgagagttctcaggaacgatagtgtgctcgtcatcgagatttaaggttctgataaatgctgatttaagttctgacaaaaagtgcagaggaccgccaaggaaagcaacatgtcccttgattggcttaccgcaggcgagaccactgatggtctggtttaccactgcctgaaagattgaagcggacaaatcctctcgggtggctccctcattgatgagaggctggatatctgttttggcaaacactccacagcgggctgcgatagggtagatggccttgtagctttttgcgtattcatttagtcctgtagcgtctgtctggatgagagaagccatctggtcgataaatgagcctgtaccgccggcacatatgccgttcatacgctgttccacgttaccgccctcgaagtatatgattttggcatcctcgccacctagctctattgccacatcggtctgtggagcatagtgtgtgagtgcggtagatacagctataacctcctgtacgaatggcacctcaaggtgctttgcaagagtgagtccgccggagcctgttatcataggacaaactgaaaggtcacctgtcttgtcgtaggcctttctgataagggactcaagtgtctcctgtatatttgcaaaatgacgctcataatcggaaaagaggatattgtcatcggcgtcaagaagtgcaatcttgacggttgttgagccgatatcaatgcccaacttatgtaagctgttattttccatagtggttcctccataatgtattacttatatgtttttatatatctttcttcttattaaaatatataattgttctattattatcaaaacagagattattatacgacagatatcgacaaattacaatgactataattataaagaatttgtgaataattcgcagtctcgttgacaaagtatgatttaactatcataataaattttgtaataaacgctgccctttgcactatagtgtaaaaggcagcaataatatgacaggaggatgcagatgcgtggttttttattgcatcaaaaccatgtctgctaaaatgtatgaactggcttaacaaactagaacaaaaatatggaagtaaagcgattccgaatatcactagaatatttatcgctgcgaatctgataggcagtgtgctgcttttgacaaagggagatgttgtcctttattatctgcagttttcagcttctgctattttgcacggacaggtatggcgtcttataagctggatttttgtgccgagcggcagcatatcatttttacagcttttatttatattctgtctgtggacgcttggagacagcatggagtcatatcttggctcttttaggatgaatgtgtactttttcggaggctttttgctgtatgatatagtaggaatgcttgcatttgcagtgacacatgtatccatcaatctgactatgtactatatacttatagctatgtatctgatgcttggtcttttgatgccggaggcagaggtgaggctttactttgtgcttcctataaagatgaagtggatggtgcttgtttacttcgtgatgtttgcatatgatgtgtatacctatatgagctttggatggcagattggattggcatacggctcagaaatcgtacttgcacttataaatctgttggtattcatttatggctgcaagcacaggctctcattcagacagaatatgcaccagaagaggagaaaggcacagtttaaggctcagttttccgaacctcgcccgggaagtggcatctcacgtcacaagtgctatatatgcggcagaacggaattgtcaaatcctgaattaacattcagatactgctcgaagtgcaccggcaacaaggaatactgtcaggatcatctgtttacacatacgcacgtataatatacatgtactactttttctaattcattgacaaagtaaactgatgaatttataatggacacagtattattttcggaggaacatttatggagaacgaggcaacagtttcgaaaaattttattgaacagattattgagaaggacttggctgagggtcattgcaagactgtaaagaccagattcccaccggagccaaacggttatttgcatatcggccatgcgaagtctattcttttaaactatggactggcaaagaagtatgacggacagttcaatctcaggtttgatgatacaaaccctaccaaggagcgtctggagtttgtagagtctatcgaggccgatgttaagtggcttggtgctgactgggctgacaggaagttttttgcatccaattacttcgacaagatgtatgagtgtgcagtaggactgataaagaagggaaaggcatatgtatctgatctgacacctgatgagataagagagtatagaggtacactcacagaggccggcaaggaggatccatactcaaagagaagtgttgaggaaaacctggatctttttgagcgcatgaaaaacggtgagtttgaggatggcacaaaggtgcttcgtgcgagaattgacatgagctcttcaaacatcaatatgagagatccgattctttaccgtgtggctcatatgacacatcacaatacaggtgataaatggtgtgtatatcctatgtatgattttgctcatcctatagaggatgctattgagggcatcacacattctatatgtactcttgagtttgaagaccacagaccgctgtatgactgggtggttattgaatgtggatttaagaattctcctgaggagtcgccaaagcagattgagtttgcaaagctctatctgactaatgttgtaacaggaaagagatatatcaagcgtcttgtggaggacggcatcgttgatggctgggatgacccgaggcttgtttctatagcagcgctcagacgcaggggcttcacaccggagtctatccagaattttgttgatctgtgtggtatatcaaaggctaacagctctgttgactacgctatgcttgagtattgtatccgagaggatttaaaggctaagcgccctcgtatgatggctgtgcttgatccggtcaaggtgattatcgacaattaccctgagggacaggttgagtatcttgaagtggacaataacgtggagaatcctgagcttggaaagagaaaggttcctttcaccagagagctttatgtggagagagatgacttcatggaggagccaccgaagaagtatttccgtatgttccctggcaatgaggtgcgtttcatgaatgcttattttgtgaagtgcaatagctgtgtgaaggacgaaaacggcaatattacagagattcactgtacatatgatccggcatcaaagggtggcaacagtcctgatggcagaaaggtcaagggaactatccactgggtttcagccgagtatggaaagcaggtaactgtacgtctttacgagaatatcgtaaatgaggagcttggagtgtacaatgaggacggaagcttaaatcttaatcctaattcactcacagtgcttgataactgtgtagtggagccggagcttatgagtgccaaggcttatgacagcttccagtttgtcagaaatggcttcttctgcgcggattgcaaggactcaaaggatggacagcctgtatttaacagaatcgtctcattaaagagctcattcaagcttccgacagctaaatagtttttgactaaaaataaacagaagagaagaatagaggtaaaatatggatttaaagtcaggtattgacaaattcggtttaaatcctgaagacataaatgatctgtatgatgaggataaagcagctgccaccggggatgctccggtggcagctgctgttcagacagaggatgaaacggattttgtttttgcaaagaatataacatgtccggtgtgtgatcagagttttcaaacactgacggtacggacatcaaagatcaggtttgctggctctgatgatgatttcagaccggtttacaagggaattgatacaataaagtatggtgtcacatcgtgtccgcattgtggttatagtgcgatgaatggcgactttgtacatgtatcgagtacacagataaggctgcttaaggagcaggttgctgccaaatttaagcccggcagcaagtcggtgcctttgttatattcgtatgatgaggcaatagacagatttaagctggcacttttttcagcgattgttaaaagggctatgtatagtgaaaaggcatatatttgtcttaagctatcctggctttatcgcggtttaatcgaacagcttacggctgatggtatctcaacggaaagtgaagagcttgtaagtgcacaaaaggcagaaaaatattattataagcaggctcttgatggaatgacaagagcggttgcgactgagcatttccctatatgtggtatgaatcaggatacggttgatttgcttttggctcagatgaattataagcttgaccattgggatgtggcttcaaagcttgttgcaagggtgcttatatcaaaaagtgcttctagacacattaaggataaggcgcttgatttaaagaatgaaattattaaaaaaataagagatgtgaaataattgctgttatttcacatctcttttattaattataacaattaattgtaaaaacaaattacatgctgataattatatcaggattaaataattaagctttaattatttttcttgttctcaagctcaagaagcttcattgcacgcaccttgagtggcagaccaaacagtgtgatgaagccgtctgcatcatggtgatcatataaatctcctgtagtaaagcttgcaagagactcactgtagagtgaatatggtgaagtagtgccggccttgatgatattgcctttatataatttgaatttaacttctccggttacatattcctgtgttgactctacgaaagcctggattgcttcacgaagtggtgtgaaccattttccttcgtatactacctgagcgagcttgttgcccatttctttcttgacctccattgtggcacggtcaaggcagagctcctcgagctggtcatgtgcctccatgaggattgttccacccggagtctcatacacaccacgtgatttcatacctactacacggttctcaacgatatcgatgatgccgatgccgtgcttgccgccgagacggttgagctctctgatgatgtctgcaaccttcatcttttttccgttgacagatgtaggaacacccttctcaaatgtcattgtaacatactcaccctcgtcaggagcatgctcaggtgtgacgcttaatacgagcagatggtcatagtttggctcctgtgaaggatcctcaagctcaagtccctcgtggctgatgtgccagaggttacggtcacggctgtagcttgaatctgtgccgaacggaaggtcgattccgtgtgccttacagtactcgatctcagcctcacgtgaatccattttccagttgtcctgacgccatggagcgattaccttgatatcaggagcgagtgccttgataccgagctcgaaacgaatctggtcatttcctttacctgttgcaccgtggcagatggctacagcgccttcttttcttgcaatctctacaagcttctttgcgatgcccggtcttgccattgctgttccaaggaggtatttgtgctcataaactgcgccggcctgtacacaaggtacgatgtagtcctcactgaactcatcacagatatcctctatgtaaagctttgaagctccggataatttagctctctcatcgagtccgtcaagctcctctccctgtccgcagttgatgcagcagcagattacgtcatagtcataagtctctttaagccatggaatgatagcagtggtatcaagtccgcctgaataagctaatacaactttgtctttcataagtgcgtgtcctcttttcgtttattctttatgatggtaaccattaactgcttttgtgtctaaaagccttgaataattactttagaataaatatataccagttctttacatattgcaagtgaaaaaatatacattattcatgtataaatatacataattttgtataatttttctctttacggattgaaattactgtactatattattatgtatgatgcgtcagacccattttatatggttatgcagaaatacaatatgaaaagaggaaatactatgataaaggctggtattattggagccaccggatatgccggagcagagctcgtgagaattttgatgaatcataaagaggtagagattgcatggtatggctcacgaagctatgtggatgagaattatgccgatatctatggaaatatgtttcagatagttgatgcaaagtgcatggatgacaatatggaggagcttgcagagtctgttgatgtgattttcactgcgaccccacagggctttttggcaggcgtgctcactgaggatatattaagtaaggtaaagattgtcgatctgtcagcggacttccgtatcaaggatgtagccacatatgagaaatggtacaagattgagcacaagtcgccgcagtttattgatgaggctgtatatggtctgtgtgagataaacagggacaaggtcacaaaggagacaaggcttgttgcaaatcctggctgctataccacatgctccatccttacagcttatccgcttgtgaaggagggacttattgatacagatacacttatcgtcgatgcaaagtcaggcacatctggcgcaggacgtggtgcaaagacacctaatctgttttgtgaagtaaatgagagcatgaaggcatatggtgttgcctcacacagacatacccctgagatagaggaacagcttggatatgcggcaggaaaagaaattcttatcaactttactccgcatcttgttccgatgaacagaggaatcctcgctacagagtatgcgacacttaagaaaaagcctgatggaacacttcctacatatgatgagattaaggcagtttacgataagtattatgcaaatgagaagtttgtcagagtgctcaaaaaaggtgtctgccctgagacaaagtgggttgagggcagcaactatgtggatgtaaactttgtgattgatgagagaaccggcagaattattatgatgggtgctcttgacaatctggtaaagggtgctgcaggacaggcagttcagaatatgaatctgttatttggcttcgatgaggcagagggactcaatatggttcctatgttcccgtaataattaataataggaaagtaattatcagaaagatgcattataatactgatagttatataaaaatataaggatgatttaataaaatgagtaatgagaataaatatgaaataagggttatgacgatagatgattatgacgaggtgtacagcctctggcagaccatccacggctttggaatccgttctattgacgactcaagagagggagtccttagatttcttaagagaaatccaactacgagtgttgtagcggtagaagatggaaagatagttggagcgatactctgcggtcacgatggcagaagaggctgcctgtatcatgtgtgcgtggatgagcattacaggaagtgcggcatcggaaagagcatggtggttgcctgtatgagagcacttcaggaagagcatatcaacaaggtgtcaatcatagccttcaaggtgaatgagctgggaaaccacttctggaaggaagagggatggacattcagagaagacttaaactactatgatttcacacttaacgaagaaaatataacaagatttaacaaataaggagcagtacaatggcagataagaacatggaacaggtaatggaaaaggcacaggtgctcatagaggcacttccgtatatacagagatttaacagaaagattatcgttgtaaagtacggcggatctgcaatggttgacgaacagcttaaaaagcaggtaatccaggatgtcacacttctcaagctggtcggcttcaagcctatcatcgtacacggtggaggcaaggaaatcagcaaatgggtaggaaaggtcggtatggagcctgtatttgtaaacggactcagaaagactgatgccgatacaatggagattgccgagatggtactgaataaggtaaacaaatctctcgttacacttgttgaggagcttggtgtgcaggctgtcggagtaagcggcaaggacggtggcctcttaaaggtaaagaaaaagtattcaaacggagaggatataggctttgtcggtgaaatcactgatgtcaatccaaaaattctttatgacctgcttgagaaggattttcttccaattgtgtgtccaatcggtcttgatgatgaatacaatacatacaatatcaatgcagatgatgcagcatgcgctatcgccagagcagtttcagcagaaaagcttgcattcctcacggatatcgagggtgtatacaaagacccttcagataagaatacacttatttcagagcttacagtctcagatgcaaagaagcttataggtgatggctttatcggcggaggcatgcttcctaagctcaacaactgcatagatgctatcgataacggagtttcaagagttcatattcttgatggacgtatcgcacactgcttactgcttgagatattcacaaacagaggaatcggaacagctattcttggagattcggaggagaaatttaacaatgagcaataatatggataaacagtcatacattgatgaggcagaaaaggagcttcttcacacctacaacagattttcacttgtacttgatcacggcgagggagtacatctttatgatacagatggcaatgcatatctggacttcgctgcaggaatagccgtatgtgcacttggatacagcaatgagcaccacaaggaggcattaaaggcacaggttgataagcttttacatacatcaaacctctactacaatgcgcctgtcatcgaggcggcatacaaggtgcttaatgcaagtaaaatggaccgtattttctttacaaacagtggtacagaggctattgagggagctatcaaggctgcaaagaaatatgcctttacaagagacggccatgcaggtcatgagataattgccatgaaccattccttccacggaagaagcatcggagcgctttctgtcaccggcaatgcacattatcaggagccgtttgagccacttatgccgggcgttaaatttgcaaattttaatgatttagagagcgttaaggctcaggtgacagacaaaacctgcgccattattatggaaactattcagggtgagggcggtatttacccggcaaagaaggagtttatcgagggagtgagagctctctgtgatgaaaaggatattcttcttatccttgacgagatacagtgcggcatgggcagaagcggcgagatgttcgcatggcagaactatgatgtgaagcctgatatcatgacctgtgcgaaggcactcggctgtggtgtgccggttggtgcctttctcatgacacagagggtggcagacaaatcccttgcaccgggcgaccatggtaccacatacggcggcaatccgttcgtaggagccgcagtgagtgcagtgtttgatgagtttaagcgtcttgacatagtaagccatgtaaaggaggttgcaccttacctggagaagaagcttgatgagcttgttgcaaaattcgactgtctcacagccagaaggggtatgggactcatgcagggcgtggagtgcagccttcctgtaggaaaggtctcagcagaggctttaaatcaaggccttatagtcattacggcaggcagcaatgtgcttagatttgtgcctcctcttgttatcgaaaagagtgatgttgacgaaatgatagaaaaacttgaaacaacacttgtaatactgtcaaaaagtctgtaaaataaagaggacatcgatttctcctttgagattatgatattaatcaaaggagaccatatgaaaaaaataatattattaagtgcgtttattttaacaatagcgtttggcctttgcggctgtaaaaaggatgatgccacagtttattttgcttctgaaacggagcagactgctgtggtttcaagtgatgtaaacagacagactgctgattccaaggagaagaaagcttcatccgatggagaacaggagcagaaggcaaaagacacagcagatgacactgatgaatctactgagtggtgcgtctatatctgtggtcaggttgccaatcccggtgtatacagagtaaagccgggcgcgagagtttgtgagctcgttgatatggcaggaggcatgctggatacagctgacaaaagcttttggaatctggcatcagagctgtatgatgggcagatgctgtatttcccgactgtagaggagcttaagtcggatcacatacctgagggcacatataccaccggcatagatggctcgctgatgaggggcggcgctgaggagcatataggcgtaaaggatggcaagctcaatatcaataccgcaactgtcgagcagctaatggctctttccggaattggtgagagcaaggcaaagagtattgttgaagatcgcgctaaaaatgggttgttttcttcgattgaggatatcacgagggtgtccggcatcggtgaagcgatgtttaataaaataaaagatgatataacagtaaattaggagtgtataaatggcaaaaaaagtgctggtcgttgacgacgaaaagttaattgtaaaaggaatacgtttcagtctgctgcaggatggcatggaggtagactgcgcatatgacggtgaggaggccttaaatatggcgaaggccaattcatatgatatgattcttttagatgtcatgcttccaaagatggatggctttgaggtgtgtcaggcaataagggagttttctgatgtcccgattgtcatgctcactgcaaagggcgatgacatggacaaaattttaggacttgagtacggcgctgatgactatatcacaaagccatttaatattcttgaggtaaaggccagaatcaaggcaatcatgaggcgcacttcaccggaacgcgcaccacaggtacagtcatctgtaatcgaaaagggtgatatcaagctcgactgtgacagcagacgtctgttcataaatgataatgaaatcaatttgactgcaagagagtttgaactgctcgagattctgatcaaaaatgaaaataaagtgtacagtagggagagccttttaaagattgtatggggcgaggattacccgggtgacgtgcgtacggttgatgtgcatgtcagacgtcttcgtgaaaagattgaggcaaatccaagcgagccgaagtacgttcataccaagtggggtgtgggatattactacaaccagaagtaatactttcagaaaggttctaaaatgtttaagagtaaagtacattttgcattttataagagtctgaaatccaggctgattttcatgatttttgttctcgttctggtaccggaggtggtgctgtgcttcggcatacttaacacctacgagtccagagcggtttcaatccgcgaaagtgaagtgcttagtcaggcaaagattctcgcaaacaagatatccacaagtaaatactttgataaggatggcagtgacttgagtaatattgatgctcagattgacactcttactactatatatgagggccgtgtgctcatagttgacaagcattttaagattattaaggatacgtacaatttagatgatggcaatactattgtctcagaggaggttatcaagaccttctctgcttcagagattactaactatgattctaaaaaccactatatcgagctttctgttccgataagcaatccaaacgacaaggattcaaagatagagggagcacttgttgtaagtgtgtcgacggacaatatatcgctaaatatgtcgtatctgacacagattgctgtgacggttgccattatcgcaggtgcggtggtgctcttttttggtgtgcttgtgcttttgcacctttttgttccgattaagaagctttctgacgagatatcagatattaaggatggctttggaaaagagcagctggatgtagatgactatgcggagactgctataataagcaggaattttaatgagctgatgagcggaatgaaggtcatggatgagtccagacaggagtttgtatcgaatgtgtcacatgagctcaagacacctcttacttccatgaaggtactcgcagattccatcaacagcatgggtgatgaggctccgattgagatgtacagggagttcatgggagatatcacaagcgagatagacagagagacaaagataataaatgacctgttatcactggtcaagatggataagtcggctgctacgctgaatatcgagagtgttaatatcaatgacctgctcgagcagattatgaagagacttcagccgattgctgacaagcagcaggtggagcttgtactcgagagcttcagaccggtaactgcagagatagatgaggtgaagctgacgcttgcttttacaaacctcattgagaatgcaatcaagtacaatgacaacgagaccggtggctatgttcatgtgtccttaaatgcggaccatcagtatttctatctgaaggtggaggacaacggtataggtataccggaggagtccttagagcacatctatgagagattttatcgcgtggacaagtcgcattcgagagagattggcggtacaggtctgggacttgccattacaagaagctctattcttatgcataggggagctataaaggctcacagtgtgatgggagagggcactacctttgatgtgcgtataccgctcaactatattgtataggaggcttgacgtgaaaagaataattatattcgtgctcactgcagtaattctgctctccatgggcggctgcacaaagaaaaaagcagataatacggttgaggtgttttgtctgaatatggatgttacgagcagcgtgccggagtcatatgtgcttagaagcaaaaactcagatgtagacaagcaggtggatgagcttctaggaagactgcaggataagcctgaagactcaagactgcgcaaggcgattccggatgaggtgtctgtgagaggtcatgacgagaaaaactataactgcactgtggatttcagcaaggagtattatgaccttacggctgcacaggaagtgcttttgagagcttctgtagtccgcacgctcacacagctggatagtatttcatatgtgacatttaccgtaaacagtattcctcttgtggactcggatgatgagattgtcggcagcatgggtgctgatgattttgttgagaatccgggtgaacagattaatacaagtgtgaaggagacgctcacgctttattttgctgacaaggatggtacagggcttgagaaacagaccagagtgatacattacagctcaaatatagcgcttgaaaagcttgttgttgagcagcttattgaggggccgaagggctctaagctcaaggcaactcttccgggcacaacaaagcttatcaatgtgtctgtggcagatagaatatgctatctgaactttgactcttcgtttagaaatactattgacaataagctgacagaggatgtggtgttgtattcgatagttaattcactcacctcacttcctactgtggacaaggtacaaatctcgcttgacggtgagaatgacggcatgctgctttataattacaagctaagcgacatgtatgagtttaataaggatatagtggattctaatgattccacggaaaaaactgaaaaatagaatggattggattaggaggagaagagtattagtaaaagaccgatgtttttatttgcgttggtctatactgcaggaactgtttcaggtatgtatggcaggggctttgggtttttgacctttgccatactgcttgtgattttaatagctgagtgtgtggcgtctaagggcagcctttccggtatcgggcgcatagttgttttgcttatcctgatatcgtcagctgtttttgcaacagcacaattcagatacgcttcagtggatgaaagccgtgacagctatatgcagtatatgacagatgaaaaatctgtcatcgtctgggggaagatttataaaactgaatacaagtatttctcatacaggtattatatgacggactgcgtagtgcagcctgagtatggcaaggcttttggcagaaaaatatcctgtggtgatgtcgtggtatactgtgacagcaaaagcgcacatctgggcgattatatgaaagcttgcggcaagataggcttgtttaagtctgcaaccaatgagggagagtttgacagagagcgcttttaccgctcacagggaattgatttctcggtgaatgcagagagtattaagacaagcgccggtaaacatgcatggtattaccacagacttgaaaaacttcgtgatatgctgtcagcttcacttcttgaggtgactgatgagacaacggcaggagtgctttcgtccatgctgcttggagacaagtcgtatctggatgatgagataaaggatttataccaggtcagtggtatttcacatatactggctatttccggacttcatatttctatagttggcatggccttttacaagcttctcagaaaaagaagggtgagctatacagcggcatttgtctgttctgcggcacttatactaagctatgctgttatgacaggaaatgccgtgtccacaaggcgtgccgtggggatgttcatacttacaatgcttgcggcagctttaggcagatgcacggatatgctcaattctcttggcatcatggtcatttacctgctgtgggacaatcctatggttttggaatatgccggatttgtgttctcggtaggggcaatacttgctataggtattgtgatgcctgtgattagtgctcctaagggcggaaaattctgggcatcagtatccatacagcttccgatgcttccggttgtggctatgaactattatgagctgcctctttttgcagtgtttgtaaatctcattgtgataccggctttgcctgtcgtatttatttcgggtctgcttgcgtctgccgcaggctgctttggcgtgatgcccggcaaactgctggtgtttcctgcatttgcggtgttaaagctctatgaggtgctttgcggtcttgttatgaagcttccgggggcaacggttatcacaggagctcctgatggatacaggattttccttttttatgctgttatgagtggctttttggtggtattttcgcttaaaaaacgtgccacagagtgtggctcaaaagaaaaaggccaaatcctttacagtgtccaaagagtggtgtgtacagcagtcctgcttgcaattttgcttgtgaagccaaaaactgctgcgcagcttgatatacttgatgtggggcagggagatggcatattttaccgctttgagtcaggcacatgcatctttattgatggaggaagctctgaccgaaaacagcttggcgataatgtgattatgccgtttcttaagtataacggcatacagagtatatcatactggtttgtttcacatgcagacagtgatcatataagcggattgtctgaggtgatagacagtgggtatactatagagcatatagttgtggcagaagcggcggctaaagaggaagctatggaggagctgctttttaaagctaaggaagcaggaattgatatatgccttatgtcaaagggggattcgattgaaataaatgatgcatcaggttcgcgcagtactgcaaatgaagaagctgatggtatcatgtgcctgtatccggggccttatgatactgccttagacagaaacgatatgtgtcttgtgctgaagctcacggatggcaggtttagtggtattttcggcggagatatatcatctgaggtagaaaagaagcttgttaatgagtatggggatgagctttctgtggatttttacaaggcaaatcatcatggttccaggtattcaagctctgcggactggattgaggctttaagcccaaggtgggctgcagtatcatgcgcggtagaaaaccgctatggacatccggctgatgaagccatggataggcttatggatgcaaagtgccgtattttatacacaatgcaaagtggtcagattaagtataaagagagtactatatatgaaaacaatagacaatgatataaaagcaggagatttcaaaaaggtttatctgctgtatggacaggagagatacctcataaaacagtacagggacaagctgataaaggctatggtcagtgagggcgacagtatgaacttttcatcgtttgagggcgatggaatcaaccagaaggagataattgacctggcggagacacttccgttttttgcggataaaagagtgattcttatagaggatgcaggcattttttcaaaggcaggcgatgagcttggagagtatttaaaggattcacctgagagcacgcactttatatttgttgaggagagcgttgataagcgctcaaagctttataaggcggcagccaagtgcggtaatcctgtggagttcaaggaacagacggatgagacacttgccagatggataggaatgaggattagaaaagatggaaagggcatgagccaggctgcctacaacagctttatagaaaaaaccggcacagatatggaaaatatcgacaaggagcttgagaagctgctgtgctactgcatggacaaggacgtgattgagctttcggatgttgaggctgtaacgacagagcagatcacaaacaaggtgtttgagatggttgatgcgattgcatcacacaaacaaaagcgtgcgcttgagctgtattacgatctgctggcacttaaagaaccggccatgcgtattatgtatcttatatcgcgccagttcaatatactgatgaatgtgaaagccatgacaaataagggctttggcaacaaggatatagcatcaaaggccggatgtccggagtgggcggtgcgcaaatatcaggcgcagtgcagggcatattcgctggatgatttaaagagggctgtgagagacggtgtggcatatgaggaggctgtgaagaccggcaggatgaatgaccagatggctgtggagctttttatagtgcagtactctgcagatatgaccggcactcatgcgacaggcagtaaatgatataacgcaaatatataaaaaacagataaaaaaacccatcggtatgacggcaccgatgggtttattatttattgctatatagtaattaagctaatccgttaacaagctttgttaaacgagatacttttctggctgcgttgttcttgtggaagataccctttgaaccagcgcttgcgataacagaagttgcatcctttaatgcagcctcagcagcagccttatcatttgcagctacagcagcctcaaccttcttgattgctgtcttaactcctgatttgattgctttatttcttgcagccttagtttctgttactaaaattctcttttttgctgatttaatgttagccaactcgtacacctccaaatatttaatctaatgtatgccaaaacagacacggacgctttggcacaaacatactagaatataatatgtcaacctttctgctctgtcaatacatattttgaaaaaaattgcaaaaaattaacatatatgtgattttggaatatcatacaggggaggtgtattgatttgtcggctgataaatggtgtgcaagaactgatctggcgcttgagacgcaggagagccttaaaaaggcaaacacagatatgagaggtgtgaatttctctgaaaaaaagctggataatggaatcatagtcagtgtagtgacaattgactcagaaaatgcagtcagggctacaggccgtcctaaaggaaaatatgtgacaattgaggctgctatgctgtccgagggagatgaggagtgctgtcaggctgtgacaagggagctttcaagagagcttaagagctttgtaaaggctgtctgtgacaagcgtatatatgcggcacttgttgtcggacttggaaacagaaatgtaactcctgatgcgcttgggccaagatgcgttgacagcttgtttatcacccgccatatagtaaaggaatatggcaggtatgcgtttagcaacgagaatgtaaacagtgtgtgcggcctggtgccgggcgtgatggctcagacaggcatggagtgccttgagataataaagggtgtggtgagcgaggtgaagcctgattttgttgtgacaattgatgcacttgcggcacgcagtacaaagaggctgggctgtaccatacagctgacggatacaggcatagtgcccggaagcggggtaggaaaccacagggacggtattaaccatgacaatctcggagtgcctgttatcgcaattggtattccgacagtcattgatgcggtgactattgtttcagatgcggtaaatgccagccgggagaacaccgcaaagctcatgtcacctaagttaaacggtatgtttgtgacgccaaaggatattgacgagacggttaagagactggcagggcttttgtctgagggcataaatatggctttttcaaacgatgaatatgatgactatagtgaataattttattgcttcgaatatcattagcgccagccgcataagctttatgtagcaggggctgcctgatgctttagatgggagatgatattgtgaagaagaaaatgattgtgcttatagcatttatatatattgcgtctatgctgttttgcggtgatggtgtgggaaagaagttcgtggaagaaaaatttccgcaccttacatattctgacaaggagtgtgatgattcaaaaaagaaggagctgcgtattgtggaggatgaggatacagcaggaggtattctctcatacgaggagcttgctgcgatggaaaatgaaaatgcaagtgtcaggaacaatatgctgccggataccgaccagctggcatttgttgatgaagctgaaaaaaaaggtgagctggcagagctcaaggagcagcagaacgtaaaaatgccgcaggtagatatgagctttgacaatctggtaaaaaactattatcaggtggacaagactacatatataggagccgatgagctgtgtgaggaggctttgcttgggcgcgatatgtctatagaaaagtcaggcgacggtcctgatatactcatataccatacacattcgcaggaagggtacagtgattcacttgatacatcagagacagagaccgtagtaggagtgggtgacaggcttgaatcacttttgagggaaaaatacggctacaatgtgctgcatcacaaggggcagtatgatgtgaatgaccgcgaccatgcgtattctaattcacttcctgagattacagagattattgagaaaaatccgtctataaaggtggttattgacctgcacagggatggagtggctgagactacaaggcttgctgccacaatagatggaaagcctatggcacagattatgttttttaacgggctgtgccgcactgctgcaaggggtccgattaatagtctgcccaatgagtatctgggggacaatctggcattttcatttcagctgcagctcatggcaaatgagtattatccggggcttgcaaggcgcatatacttaaagggctacagatataatatgcatctgtgtccgaaatcgctgctcgtggaggtgggagcgcagacaaataccaaggaggaggcatacaatgcaatggaaccacttgcagatatacttgataaagtgttaaaataatatagactttatttcacaaatctgataaactttgatgagttattgaaagtattaggaggacatatgtcaatagatcagagcaaaatccgcaatttttgtattattgcccatattgatcacggtaaatctacactcgcggacagaattatagaaaaaacaggcacacttaccagcagggagatgcaggctcaggtgctcgacaatatggatttagagagagagcgtggtatcacaatcaagtctcaggcagtccgtattatatataccgcaaaggatggcgaagagtatatttttaatctgatagatacaccgggacacgtggattttaactatgaggtatcaaggagtcttgcggcatgtgacggagctatacttgtagtggatgcggcccagggcgttgaggcacagacacttgcaaatgtttaccttgcactggatcatgacctggatgtatttcctgttataaataaggtggatctgccgagtgcgcgcccggatgaggtggcacaggagattgaggatgttatcggtattgaggctatggatgcaccgcgtatttccgcaaagacaggactcaatatagaggatgtgctggagcagattgtaaaaaagattccggcaccaacaggcgataaagatgcaccgcttaaggcgcttatatttgatgcaacatatgattcttataagggagtcattattttctgccgactgagagagggctctgtaaaggtaggagacacaataaagatgatggctacaggtgcatctgatgtggttacagaggtggggtattttggcgcaggccagtttataccatgcgatgagctttcggccggtatggttggatacattgcggccagtatcaaaaatgtcagggatacacgcgtgggtgatacagttacactcgttgacagaccgtgcgatgaggcgcttccgggctataagaaggtcaaccctatggtttactgtggtctttatcctgcagacagtgcaaagtatcctgatttaagggatgcgcttgaaaagctgcaggtcaacgacgcttcattacagtttgagcctgagacgtcactggcgcttggctttggcttcagatgcggattccttggtcttttacatctggaaattattcaggagagactggagagagagtttgatctggatctcgttaccactgcacctagtgttatttacaagattcacaagacaagcggtgaggtgatagatctgaccaatccttcaaatatgccggatccgtcagagattgagtatatggaggagccatacgtatctgcagagattatggtcacaagtgactatgtcggtgcgattatgaagctgtgccaggagagacgaggagtctatatcagtatggagtatatcgaaaaaacacgagctctcataaagtacgacttgccattaaatgagattatctatgatttctttgatgctttaaagtcacgctcgaggggttatgcttcgtttgactatgagatgaaggattatgagcgctcagagcttgtcaagcttgacatcttaatcaataaggaaatggttgatgcactttcatttatcgtattcaaggagagcgcatacgaaagaggccgtaagatgtgcgagaagcttaagggtgagataccaaggcatttgtttgagatacctattcaggcagcagtcggtggcaagattatagcaagagagacggttaaggcacttcgcaaggatgtgcttgctaagtgctacggtggtgatatttcacgtaagaagaagctgcttgagaagcagaaggaaggaaagaagagaatgcgtcaggtgggcaatgtagagataccacaggaggcattcatgagtgtgcttaagctggatgaggagtaatcgcacatatgaataatcttgagatttatattcatataccattttgtgtgagaaaatgtgaatattgtgattttttatcatttcccgcagacgatgatgcaaagcttcgctatgtcaaggggcttatggcggaaatgatattttacggcccgcttatgaagaactatcaggtgtcatctgtctatatcggaggaggtacaccaagctctatagatgagcagtggattgctgctttgatggagggcgtgtttgactgctttaatgtgctgcctgatgctgagatatccatagagtgcaatcccggtacgcttagcagggaaaagcttttagcatacagggatgcgggaatcaaccgcctgtccataggactgcagtcggcaaataatgatgagcttaagctgctcgggcgtatacatacttttgaacagtttgtgacgaattacgaggtggccagaaacgtgggctttaaaaatatcaatgtagatttgatgtatggtctgccgggacagtcagcgtcacagtatatggcgacagtaaacaagattataaggcttcatccggatcatatatcggcgtattctcttatagtggaaaagggtactcctttctatgaaaagtacaagtttgacatggtgcgccaggaggcgggcatgagaacggagtttctgcctaatgaggacgagttatatgatatggaaaaggcgggacagaaggcgtttatggatgccggctacaggcaatatgagacatctaactatgctaaaagaggtatggagtgccgccataatataggttactggaccagagctgactatttaggacttggaataggggcggcatcgcttatatcaaatgtcagatataccaatatatccgatatggacgaatatctgtcgcgctgccgtcatatacatgatgtgggtgatgatatatttaaggccaatctgcatgtggcagctgatgttatagacaaaaagggacagatggaggagtttatgtttcttggacttcgtatgaatgagggggtcacaagagaagcctttgagagggcatttggtatttcgatagatgcaatctacaaggatacgatagacagcctgaaaaaacaggagctgctcgtggtaaaggccgggcatatctatttatcggagagaggaaaggatgtagccaattacgttatggcacagtttttgaaggattaacggagagcaaattatggatatgacttttaagcttcaggtgtttgagggaccgcttgacctgcttttatacctgatagagaaaaataaagtaaatatttatgatatcccgattgtcgagattacagcgcagtacatggagtatgtgaatcagatgaaaaaggataacctggacacgctcagcgagtttctcgtgatggcagctacgctcctcgacataaagtcaaagatgcttctcccaaagaaagaggaagaagagcaggagcaggaagatccaagagcagagcttgtgcagcagctgcttgagtacaagatgtacaagtgcatggcaaatgagcttaaggatcgccagctggatgccggcaaggtgtggtataagaagaaggacatacctgatgaggtccttgcatatgaggagcctgttaatcttgatgagcttgtcggagatatccgtctttctgatttaaacagaatctttcaaagtataatgaagagacaggaagaaaaaatagataaggtccgttcgaagtttggaaagattgaaaaggaagaggtctcattagaggaaaagatggactttctgacagactatgctgcctcacacaagcacttcagcttcagagggatgcttactgcatcgtcaagcaaagtggaagtcatagttacatttcttgccatactggagcttatgaagaccggcaaattaactatcgttcaggagcatatttttgatgatatccggattgagtcaaggattgctgcataaagagggtttgaggatatatgaattataaagctgcaatagaggctattttatttaccatgggagaatctgtggagcttggaaggatagccgatgcaatacaattaaatgaaaaagaaacaaaaaagctgcttgacgagctgattgaggagtatagaagctcttcaaatataggtatgaatatcatagagcttgatggtgcttatcagatgtgtacaaagccacagatgtatgaatatctcatccgcattgcaaagcagcctaagaagagggtgcttactgatgtgcttttagagactctttcaatcatagcgtacaagcagcctgtaacaaaggcagaaatagaaaaaatcagaggtgtgtcaagtgaacatgccgtaagcaagcttgttgagtacaatctggtgcaggagcttggaaggcttgatgctccgggaaggccgcttttgtttggtaccacagaggaatttctaaggagctttggggtttcgtctatcgacgagctgccggtactaagccctgtgcaggttgaggagtttaagcaggaggcagaggaagagatgcacgtgaagcttgatgtgtagtgcaggtgtattgcgtaagctgccatttcatataataaggacatgcaaataatcatatatattaccgatggaggtaattatatgattatttttttgaaaaaatataagtcgaagatagctttaatggttttcatttgtgtgttggtttgtactgtcagctgtttgcttgattttaagacgctggaaaagcaaaaaatgcccggtttggaaaagaaaagtgtgtttatggcagctgaaaatactgttgctaagaatactgacaaagccgtaaatgaacccaggcttcatgctgtttcagcggcattatatgatgcggatgacgagacgtttatatatggtaaaaacatgagagacagcatggcaaatgccagcaccacgaagcttcttacgtgcattgtggcacttgaaaaagctgatataaatgatactgttacgatttcacaaaatgccgcatcacagcctgcggtcaagcttggacttgtggcagggaatagctataatatgaaggatttactctatggcatgatgcttgagtcgttcaatgactgtgcctatgcgattgcggagcatgtgggcggctcgacggagggctttgcaaagcttatgaatgaaaaagcaaatgagatagggtgccttggcacgtattttattacaccaaacgggctggatgctgagaatgatataagctttcaccactccacagcgggagatttgtgtgttataatgtcttattgtgcgtggaaatcaccaaaatcaacacagtttcttgagataacacagactatgcagtacacgtttgagacagaggaaggtaagatggtttttaacaatcacaacaggctcattacggagacggactactgcatatcgggaaagaccggctttaccacaaaggcaggctactgctatgtcgcagcagttgaaaaggatggaaggagaatgtgcctttctctcttgggctgtgggtggccaaacaataaaaactataagtgggctgatgcaaagagtctggtggagtatgcggtttcagatgctgccgaagattcttactgtgatgctgcttgtgtaacaacacaacagaccggtgatacacgaaacacaattaacttaaaatatatagaaaataacaagaaaaataagaaaatttgcaagaattttctcaagaattttacaattaatataggaaattttttctaaacaaaaattaaagttaaaaatttaacaaattagttgaaaaaaatttagaaatagtctattatcatactagcgaagaattttatttttttatagatggaggatataaaatgagtagtaacaatcaaagcttggcaatgcagcgtattgctaagttagtcgacgagaacagtttcatggaaattggttctcttgtgacagctcgcagtacagattttaaccttactgcagcaaaagctccttcagatggtgttattatcggacacggtctgattgatggaaatcttgtatttatctacagccaggatgcaacagttcttaacggaacaatcggcgagatgcatgcaaagaaaattgcttctgtatatgatatggccatgaaaatgggtgcgcctgttatcggatttatcgattgcggtggtatcagacttcaggagtcagttgatgcattagacggatttggtcttatctacgccaaggaagttgcagcaagtggcgttattccacagatttgtggtgtattcggtaattgtggtggcggactttctgtagtaccggctctttgtgatttcgcttatatcgaagagtctaagggcagaatgtttgttaatactcctgatgcaatagagggtaaccgcgttgagaaatgcgatacagcagcagcttcattccagagtgagaacaatggatgtgtagacggaatcggttcagaggatgatattatcgctgatatcagagctcttgtcagcatgcttccactcaacaacgagggagatgtatatacagactcatgtgaggatgatctcaacagagcatgtaacagcatggctgatatgaaggctgatccaagattcctcttatcagagctttctgatgatcatgtattctttgagacaaagaaagactttgccaagaatatggttacaggttttgttaaattaaacggcatgacagtcggtgcagttgcaaactgcagcacagtatatgatgctgagggcaagaaggcagaggcgtttgcactttctcttactgcaaagggctgtaacaaggcagctgagtttgtatcattctgtgatgctttctcaattcctgtacttacacttacaaatgtaaacggattcaagaactgcatgtgctctgagaagaagcttgcaaaggctcttgccagaatgacatacgcattctcaagtgcaacatgtccaaaggttaacctgattacaggcgaggcttacggaagcgcatatgttgcaatgaactctaagtcaatcggagctgatatggtttatgcataccctgatgcaaagattggtatgatggattcaaagattgcagctgagattatgtatccgggcgctgatgcaaaggaaatcgatgagaaggcagctgattatgagaagcttcagtcttctgtttcatcagcagcagccagaggatatgtagatctcatcattgatccggctgacacaagaaaatatcttgtaggtgcttttgagatgctttacaccaaatatgtagatgcaccagagaagaaacacggaactaaataatagaaaggcgcattttgttatgaagaaaaaaataacatatatccttagccttcttatgattgtatgtatgcttggagcatgtggctctgacaatgccgaaaagacatacggcggatacacaacagacgagcttcatactgaggcaacagacagccttggcaatatccagaactacattgcgctcgtagataattgtggcggttatgacaactatgagaagagtgtcaaggaagttgaggagaagacaggcatgacagagggtgaggttgtttacaacacactcggacagtcgggagcaagcgtttcaatgaaaaatatcgacgctgagcttgatgctgtttcatcatggcttgatctggttgacaaatacggagacgtaaaggatgcaactaatggcaaggattttacagtaaccaagtcaggtggtacactcactaccgatatgacacttacatttggcaagcaggatgtaacatacgaattagtatatgattcggttaccatggaggtaacaggtatctcacttactcctgttcagacaatggggcagaagcttgctaaggcaggacagaacacagtaatttcaatgagtattgtattctgtgtacttattcttatctctcttatcatttactgcttcaagtttattgctcttatcggcaataagccaaagaaggcagaagcaaagagcgagcctgaaaagaaagagactgctgcagctgcacctgctgcagaccttacagatgatacagagcttgtagctgttatctcagcagctatagcagcaagcgagggtactacaacagagggctttgtagtccgttcaatcaatagaagataatttaggaggacatttgagatgaaaaactatacaattaccgttaacggaaatgtttacgatgttacagtagaagagacaggaagcacacctagcacagcaagcacacctagaagagcagcagcacctgctgccgctgcaccaaaggctgctgcacctgcaggagcaggaagcatcaaggttgaggccggagctgccggaaaggtatttaagctcgaggctaaggttggcgatgcagtaaagaagggtgatacacttcttattcttgagatcatgaagatggagacacctgttgttgcaccacaggatggaacagtagcaagcattgatgttgctgttggtgattcagtagagtcaggtgcattacttgcaacattaaactaattccaggaggtaaactaatttgagttacgtaggtgaaacactttcaaacctcctacatcagactgccttttttaatctgtcagtcggaaactatgttatgattgccgtagcatgtgtattcctgtttttggctattaaaaaaggatttgagcctttacttttagtacctattgcttttggtatgctccttgttaatatctatcctgatattattgtaagcccggagcactcaagcaatggagtaggtggtttactttattatttctatacacttgatgagtggtcaattcttccttcactgattttcctcggtgtcggagctatgacagactttggtccgcttatcgcaaaccctatcagcttcttactcggagctgcagcacagtttggtattttcggagcttatttccttgcaatccttctcggatttaatgacaaggcagcagcagccgtatctatcatcggtggagctgacggacctacatctattttccttgccggaaaattaggtcagacaggtctgatgggacctatcgccgtggcagcgtactcgtacatggcattagtacctatcatccagccgccaattatgaaattatttactacaaagaaagagcgtgcaatcaagatgcagaaccttcgtcctgtaagcaagcttgagagaattctcttccctgtagtagttactatcgttgtttgtacactgcttccaactacagcaccactcgttggtatgctcatgcttggaaaccttttccgtgagtctggtgtagtacgtcagcttcaggagacagcaagcaacgcccttatgtacattgtagttatcttactcggtacatcagtaggtgcttctacaagcgcagagtcattccttaatatgagcacaatcaagatcgttatccttggtcttattgcattcatggtgggaactgctgccggagtactttttggaaagcttttatgcttctttacaaaaggcaagatcaatccacttatcggttcagccggtgtatccgctgttcctatggctgcccgtgtatctcagaaggtcggtgcagaagaggatccaacaaacttccttcttatgcatgctatgggacctaacgtagccggtgttattggaactgccgtagcggccggatgcttcatggctatattcggtatttagatttaattaaggaggattaatcatgtcagaagtggtaaagaaaccattaaaaataacagaaactgttcttcgtgatgcacatcagtcactgattgcaaccagaatgacaacagagcagatgcttccaatcgttgacaaaatggacaaggttggatacaacgcagtagagtgctggggtggtgcaacatttgatgcctgccttagattcttaaaggaagatccatgggatcgtctcagaaaattaagagacggcttcaaaaatacaaagctccagatgcttttccgtggacagaatatcttaggatatcgtccatatgcagatgatgttgttgagtatttcgtacagaagtcaatcgcaaacggaatcgatatcatccgtattttcgactgcttaaatgatatcagaaacttacagacagcagttacagcatgtaacaaggaaaagggacatgctcaggtagctctttcatatacacttggagatgcttacacacttgactactggatggatatggcaaagagagttgaggacatgggtgctgactcactttgtatcaaggatatggccggtcttttagtccctgcaaaggctacggagcttgttcaggctttaaaggattctacaagccttcctgtcgagcttcatacacactacacatcaggtgttgcttcaatgacatacatgaaggctgttgaggccggagttgatatcattgacacagctatgtcaccattcgctcttggaacaagccagcctgcaacagaggttatggttgaggcattcaagggcacagagtttgatacaggtcttgatcttaatctcttaagtgagattgctgattacttcagaccaatgagagaggaagctttagcttcaggtctcatgaacccaaaggtactcggagtaaatatcaatactctccgttatcaggttcctggaggaatgctttcaaaccttatctcacagctcaaggagcagggcaaagaggacaagtacgaggaggttctcgcagaggtacctcgtgtgcgtaaagacctcggtgagccaccacttgtaactccttcttcacagatcgttggtacacaggctgtatttaacgtactcatgggcgagagatacaaggttgctactaaggagactaaggatatccttcttggtaagtatggtcagacagttaagcctttcaacccagaggttgttgacaaggttcttggtgatgataagaagaatgccatcacatgtcgtccggcagatcttcttgagccagagcttgacaagattgaggctgagatgaagcagtggaaacagcaggatgaggatgttctttcttatgctctcttcccacaggttgctactgatttcttcaagtacagacaggctcagcagacaggtgttgatgctaaggccgctgatactgagaataaggcttatcctgtttagtatttaaaaatataattcatgcttttgaatttcaagcaggtccggctttgccgggcctgttttttggtgatgagatatggagaaaagtaagtcccgggcaccgggcaggcacgcacactttcatgtgtgcgaatagcgcagcctcttagatactatagaaattatgcccatgaaacacagaaatgtcctgccatggacggcaggacaaggtgttatgcgccatggatggcgcataaaagccggtttcgtcaagcatagaacaactacaagcataatttcgtacagtatcttagagacgtagcgtagcgcacgggaaagtgtgcgtgtctgtccggtgccctggacttacgagtctattttatggcaaaaataaaaaatataaattcgctctttcatatagaggaaaaaagtgataatattttaaggtatgaaaaaattgctgcaaaacacacaaacgtgtgaagcacagccataaacgggaaagctcaggagtataagatgtcaaatactaacgacttacttaacaggataaatgctaaatacagtacgatgagcaaggggcacaagctgcttgctacatacataactgataattatgataaggctgtctttctgacagcggctaagatgggcgagacggtaggaatttctgagtctacggttgtcaggttcgctacatcactcggatataagggatatcccgattttcagaaggcacttgaggagcttgtaaggaacaagctcaattcggttcagcgaatggaggtcacatatgggcgtatcagccagtcacagattcttgagactgtactgcagtctgatcgtgacaagattaagaccactctggaaaaaattgatgcggatgcatttgacatggcggtagatactattttacagtcaaggaaaatttatattgtcggaatcagaagctgtgcacctcttgcgagctttcttgcattttatatgaatctgatgtttgaggatgtgtgtctgcttacgacaaacagctctagcgagctttttgagcagatggtgcgtattggcaaggatgatgtgattatcggcatcagctttccgcgttactctatgcgtacacttaaggcactggaatttgccaacaacaggagtgcaaaggttatcactatcacagacagcattcattcaccgatgaatctgtattcttcatgcaatctgattgccgacagtgatatggcctctatagttgattcacttgttgctccgctttctgtcatcaatgccctgattgtggctctttgcatgaaaaagcagagtattgtcgcaaagacactgacagagcttgaggatatatggaatgagtatcaggtgtacgagaatgatgagattgattacattgatgactctataaaggtacattacgctaagctgggggattcgcaggatgagtaagaatattattgtggtaggtggcggagccgccggaatgcttgcggcgtattttgctgcagaagcagggaataaggttacgcttcttgaaaaaaatgaaaaacttgggaagaaaatatatataaccggcaagggcagatgcaacctgaccaatgcgtgcgatgtcgaggagctttttttaaatgtaaagagcaacagtaagtttttgtacagcgctttttatggctttgacaacagcagggtgattgatttttttgagagtcatggcatgcctgtaaaggtggaacgtggcaatcgtgtatttccggtatctgataagtcgtcggatgtgatttttgctttacagaaagctttgaaggaaaagaatgtggaggtattacttcatacggaggtatcaaagctgtgctatgagaaaatcactgatacaaaggcagatgaagaagctgctgataaaaaaactgaattaaaaataacaggtgtcatattaaaggatggcaccacaatggctgctgatgcagtcattgttgccacaggaggactttcatatccgtctacaggctctacaggtgacggctacaaaatggcagaggatgcaggtcatactgtgacagagtgcacaccgtcgcttgtgccatttaatgtaaaggaagagtgggtaaagagtcttcagggactttcccttaaaaatacggctatttccatatatagtggcaaaaagaagctttatgaggattttggagagatgctttttacgcatttcggggtcagcggccctatgattttgtctgcgagtgcatcaattaagcaaagccttattaagcagcctcttgacatgtatattgatttgaagccggctctcacgcaggaggccttggacaagaggattctcagggagtttgaggaggcaaaaaacaagcagtttaagaattcgataaacaggcttttgcctgcaaaaatgattccggtgataattgagctttcaggcattgaccaggataagaaggtcaatgagatatcgaaagaggaaagaaacagacttcttatgctttttaagaagctgcctgtcactcttaatggcccaagaggatataatgaagctattatcacaaaaggcggcataaaggtgaaggaaatcaatccatccaccatggagtcgaagcttgtgaatggcctctactttgccggcgaggtgttggatctggatgcatatacgggaggtttcaatctgcagatagcatggtccacaggatatctggcaggaacaagtgcagcggtttgatgataatgaacaataatattttaaggagaaattatgagatacaatatagcaattgacggaccggcaggagccggaaaaagcactatagcaaagagacttgcaaaggaacttggcgcaatttatgtcgatacaggtgccatgtaccgtgccatggcatactattttatccaaaagggtgtggacaaggaggatattgacaccatcacgaagctgtgtaaggatgttgaggtttcaatcagctatgaaaacggtgaacagcaggttatcttaaatggtgagaatatcacaggctttataagacaggaggctgtcggcaatatggcatcagcaacaagtgtttatcctgtagttagagaaaagcttgttgagcttcaaagacagctcgctgccagagagaatgtggtgatggatggaagagatataggaactgttgtgcttcctgatgccaatgtcaagatatttttaacagcaagctctaaagtacgtgcaaagagacgcttcgatgagcttaatgcaaagggtgagaagtgcgatattgatgcaatcgagaaggatattatagagagagaccacagggatatgacaagagaaacatcacctttgaagcaggcggatgatgctgtgctgcttgattcgtctgatatgacaatcgatgaggtggtagatagaatgaaacagcttgtgaaagaggcatagcgtatgggagagcttactatcgcaaagagcgccggcttttgttttggagtgacgagagcggtaaatatggtctatgaggcaattgaaaaggaaaatgtgcctatatacacctatggcccgattattcacaatgatgaggtcgtaaaggatatggaaaaaaatggcgtaaccgtcataaacgatctcgatgagctttcttctcatgaaaagggtgtgatgattatccgttcacacggtataagcaaggctgagtatgacaggataaaaaactgtggctttgaggtgcttaatgcaacctgtccttttgtatcaaaaattcacagatatgtggaggattacagctcaaagggctatgatattataattgtcggcagtccaatgcaccctgaggtgtgtggaataaggggctgggcagacgaaaaatgccatgtaaccataataaattcgcctgaggatgccgaaaattacatgaaaaatagtacaaaaaaactatgcatagtgtcacaaacgacatttaactacaataaatttcaagatatagttgaaattattgcaaaaaaaggttatgatataactgttttaaatacaatctgtaatgctacagaggtcagacagaccgaagcaagaaaggtagcacagtgctcagatgtcatgattgtcataggcgacaggcacagctccaatacacagaagctatttgaaatatgtaaaaacgaatgcaaaaatacttactatatacagacaagtgacgaaatggattatacacaaatcaggtccaacaataacgtaggtattacagcaggggcttcaaccccaaataatatcattgaggaggtttcaaagaatgtcagaaatgagctttgaacaaatgctggaagaatcttttaaaactataagaaatggagaagtggtagaaggtaccgttattgatgttaaacctgacgagattttcttaaatattggatacaaatcagacggaattattactagaaacgagtacacaaatgagccgaacgtagatcttactactgttgtaaaggttggcgacaagatggaagccaaggtagttaagcttaacgatggcgagggccaggttatcctttcttacaagcgccttcaggcagagaagggcagcaagcgtcttgaggaggcttttgagaaccaggaagtattaaaggcaaaagttacacaggtattagccggtggtgtatgtgtcagtgttgatgagacaagagtattcatccctgcaagccttgtatcagatacttatgagaaggatctcaacaagttcaaggatcaggagattgagtttatcatcacagagttcgatccaagaaagagacgtattatcggaaatagaaaggtattactcgttgagcagaaggctaaacagcaggaagagcttcttgcaaatcttcacgttggcgatgtaatcgaaggaacagttaagaatgttacagatttcggtgcattcatcgatcttggcggagtagacggattacttcatatctcagagatgtcttggggcagagtagagaaccctaagaaggtattcactgttggacagactgtaagagtatttgttaagaacatcaatggttctaagattgctctttcaatgaagtttgatgacgagaatccatggaatggtgcaacagagaaatttgctcctggcaatatcgtaaagggcaaagtagccagaatgacagattttggtgcattcatcgagcttgctcctggtgttgacgcacttcttcatgtttcacagatttcaaaggatcatgttgagaagccatcagatgttctcaagattggtcaggaggttgaagctaaggttgttgagttcaatgaggacgataagaaaatcagcttaagcatgaaggctctccttgattcagaggatgatggagcagatgttgcagatgtaaatatcgatgaggttgcttctgataacgagtagtttttgattttaaagctgtcatatataattatatggcagcttttatttgtatcgggtggcacctattggaggattgtgatgtttgatcattatgaatggtttaaaaatgaagtgtacaggctgacgcagatagatctcaattattataaagaaaagcagatgcgcaggcgtattgatactcttgcgaaaaaaaacggggctgattcttatgagacatacattgatatgatttctgcagataaggctaagtttaaacagtttatcaattttatcactatcaatgtatctgagttctataggaatcctgatcagtggagttttttggacagagaggtcattcctgagatattaaagaacaatacagggactattaagatatggagcgcggcatgctcaacaggggacgagccgtattcgcttgccatggctttttcgaagcatgttccactgtcccgtataaagatactggctacagatattgacgaccaggtgattgcgagtgctaaagccgggctttacagcgcaaagtctgtagaaaatgtgccggctgacctgaagaagaagtactttacccaggtggagggctcatacaagatatctgatgatatcaagcgatgtgtgacctttaaggaacacaatctgttgaaggattcatatccaaaggattacgatcttatcctgtgcaggaatgtggtgatttattttaccgatgatgcgaaggatatgatatacaaaaatttcttcaatactttaaaatccaagggaatactgtttataggcagtactgagcagataactacatatcgtgagctcggctttgagagattaagcagtttctatttcagaaagccatgatatcttatcagaggttaaacagatggtctgttatgtgttttacatatgacagtaccatctgttttgaatttataaaatcctcagtcagcaggaaatagctgtacttatcctttatatcgaatcgaaactcgggcttcatgaagtcagagtactgtctgatgaaggtaccggttttgcgcacatagcagttgtacgccttgcatttttcgcggtattcgtggtcgacatatgctgcgacactcttgtgtatggccatgtcctcctttggcagatagtagtaatttttgtaatcgctgtaaaaatggcgcatttccccctcgaatatctctgcacgcacatagctttttgtagtgccgatggtcagatagatgtcattgtcatggaagcttacagattttggaacggaaaatttattttcaaatgatatgataagctcattcatcaggctgccgtcataagctgtatatgggtttacggatacaccggtgatatctgcaatgccatgtatgcattctttatacgaaagtatactaaggagctttgtcatgccaaggacatcctcgtagttgtgtgtcaaaagcagggatagcttttcgtcgtccttttgggcaagatattcataataaacgtttatgagttcaccaccggaatatttatcctccctatctatacccagaaatgcttcgatgcttttttgtttgtagttttcgaggcacaaaagaggctttatcggggaaagttccttaaagatatcgagtatctgcacattacagaaggggtcttcctgcttatatttcttgtatttattctttaaaaatggtatatcaaaaccgacgccattgaaggatatgatagtgctgcaacctgacagacttcctgcgaaggcttcaattacagctgcttcgtcatcgacagattcggcaaaatactggtctattacaatgcggtttttgatgcgccttgcacagcctatcatgtagacaattgctttcaccggtgaaaagcctgttgtctcaatatcaaagaacatagtgttttctttaaatatgctgtctgaaaaattatcggtttttatgtaaatttcttcattgtgaaatattttcatttctcgattcctgccttgaatatcatttgtataaacattataacataaagtattaaaaaaagtacataatatactatttaactaaaaatcataagtggtataataagaacagtaatgtgcaatagcatttccacgttattaatctaaaagaaagaggggcacaaaaatgggtcataaaacgtttattggcggtgttcatccatatgatggcaaagagctgtctaaggattcaccaattaaagaagttttgcccaagggcgacatggtatatccggtttcgcagcatatcggcgcaccggctaagcctgttgttgccgtaggtgacactgtgttgaagggacagatgatagcagaggccggtggctttgtttcatcacctatctattcatcagtgtcaggaaaagttaaggctattgagaagcgacgtgtggcggtcggcgatatggttgacagtattgttatcgaaaatgatggcatgtttactgagacaacatatgagagcgtcgaggatgtcactgcgctttcaaaggaagaaatcatcgagaaggtcaagaatgcgggagttgtcggcatgggcggtgccggtttccctacacatgtaaagctttctccaaaggagccggacaagattgagtatattatcgcaaactgcgcagagtgtgagccttacctcacatctgactacagacgtatgcttgagaatcctgaggaattaattggcggcatgaagatcatacttcagctttttgacaatgcaaagggtattcttggtatagaggataataagcctgactgtatcgaaaagctcacagaactcacaaaggatgagccgcgtattgaggtttgtccgcttatgacaaagtacccacagggtggtgagagacagctcatctatgctacaaccggcagagccatcaattctaagatgctccctgctgatgcaggttgtattgttgataatgtagagacaattattgctgtatacaatgctgtaaagaatggacagccagtccttaagcgtatttcaacagttacaggagatgctgtgaagaatccttccaatattttatacagcatcggtacatcatatcaggagctggttgatgctgcaggtggctttaagagccagccggagaagattatatcaggcggtcctatgatgggctttgccatgtttagtcttgatatccctactacaaagacctcttcatcaatactgtgcttcacacatgatgaggtggcagcatttgagccacaggcctgcattaactgcggtcgttgcgtggaggcatgtcctgagcagctcattccaagccgtcttgcgaagtttggtttgcgtggacagatggatgagtttgagaagtggcacggacttgagtgtattgagtgtggaagctgttcatttgcatgtccgtcaaggagacaggtggctcagcctattaagacaatgaagaagcttgttctcgctgaaaagagaaaacaggccagcaaaaaataaagaaagaggtggattaaagtgagtgatttatttcatgtttcatcatcaccacatgtacgtgccaaggattccactgacagaataatgctttatgtcattatagcattactcccggcaagtctttttggtatttacaattttggatttagagcactttttatcattctgcttaccatcgcatcgtgtgtggcatcagaatgggtgtttgactacatagttaagaaaaagagcacaattaccgatcttagtgcggttgttacaggactgcttttagcactaaaccttccggttgcacttccatggtgggaggctgtactcggtggagtatttgcaatcatcattgtcaagtgtatgttcggaggactcggacagaactttatgaacccggcacttggtggaagatgcttccttctcatcgcatttgcggctgatatgactaatttcaatgtcacaagaaacggtgtggatgtatactcaggagcaacaccacttgcgctcatcaaaaatgagggactttcaagtgtcaatgtaagggatatgcttataggaaatactgcaggaacaatcggtgagacatcagttatagctattttaataggtgctatcatcatgattttacttggagtcattgatttaaagattcctgcatcctacattattacatttgctgttttcatgttccttttcggagcacagcagtttgatatcaactatgttgttgcagagctctgcggtggcggactgatgctcggtgcatttttcatggcgaccgattatgtcacaagcccgattacgccgatgggcaagataatattcggtatctgctgtggtatattgacaggagtattccgttgcttcggtgccaatgcagagggtgtttcctttgctatcatcttaagcaactgccttgttcctattattgagaaggtttctatcccaagagcctttggtatggtaaaggaggcaaagaagaatgaataaacgtattgtacatgacgctttgattttaactgcctttactctggtgcttggttttattcttgccctggttcagggaatcacggcagagcctatcgacaaggccaataaagcagcagcacagaaagcatatcaggcagtattttcggatgcaaaatcatttgagaaatatgattatgatgctgatgaagctgataagcttgtatctgatgcgggctacaaggatacaatcgatgatattgagactgcccttgattcaaacaaagagacattaggctatgtcatcacagttacagccaaggatggaagccagggaagtatcacattctctgtaggtatcaagaatgatggtactgtaaacggttactcaatcacaagcatcagtgagactccgggacttggaatgaaggccgaggaggctgatttctacaagcagtttgagaacaagaaagtagacaagttcgacgttgtaaagaccacaccttcaaaggatgatgagattgaggccatcacaggctcaaccatcacatcaaaggctatggccaacggctgcaacgcagctattacttacttccagaataaattacagggaggtgccaactaatgaacaaatatgtagagcgtttatataatggtatcattaaggaaaatcctacctttgtacttatgcttggtatgtgtcctacactggctgttacatccagtgcggtaaacggacttggaatgggactttccaccacggtggtacttatatgttcaaaccttttgatttcacttttcagaaaagtgattcctaacggagtgcgtatgccggcgtatatcgtcatagttgcatctcttgttacagtagtacagtttttaatgcaggcttatctgcctagcctttcagcagcacttggtgtatacatcccacttatcgtggttaactgtattatcctcggacgtgccgagagctatgcttcaaagaatccgcctgtagagtctatctttgatggaatgggaatgggacttggatttactatgggtcttacaatcatcggacttatccgtgaaatcttaggtgcaggaacattcttcaacatcaagattttcggtgactggtttacaccaatcacaatctttatcatggcaccgggagctttcctcgtactaggcttcctcgttgcaggcatgaatatcatccgtaaaaagatggaagcaaagggtacacctcttgcagagccggcaggctgcctttcaggagactgtgcacattgtggagcatcatgtccatcagcaaaagcagcacaggctgctgttgcgcctaacactacagaaggaggggataaataatgggtacattaggtcatttactgctcattgcagtagcatatgcaatagttaacaacgtagtacttagccagttccttggtatctgtcctttcctcggcgtatcaaagaacacaaaaactgctgccggaatgggtggtgcggtaattttcgttatcacaatcgccacattcgttacacagcttatttacaattttatattgtatccgcttaatctgtcatatttacagactatcgtgttcattcttgtaattgcagcacttgttcagtttgtagagatgttcttaaagaaacagatgccgcctctttacaaggcactcggtgtgtatctgcctcttatcacaacaaactgtgccgtactcggtgtagcacttaacagtgtaacaaagggctacaatatcttagagagtgtagtttacggctttgccacagcttttggtttctttattgccatcgtgcttatggctggtgtacgtgagaagattgagtataatgatattccaaagcctttccagggaacagccatcgtgcttcttacagcatgtcttatggctatcgcctttatgggattctcaggaatggtttctgtataggattggaggaaaagtgatatgaatgttactgcgattattattgcagctttagttgttggagctgtcggtataattcttggatttttcctcggtatttcaggagaaaaattcaaagtagaggttgacccgagagaggaagcaatacttgaagtgcttccgggcaacaactgtggtggttgtggatatgccggatgctccggacttgctgccgccattgcaaagggagaggcaccggtaggacagtgtcctgttggtggagaccctgttgcggcaaaggtcagcgagattatgggtgtaaaggttgaggccggagtaaagaaggttgcatttgtaaagtgcgccggtacctgcgacaaagcaaatacagactacgactatacaggagtagaggattgtgttgccatgtcatttgtacctggcggcggacctaagtcatgtaattatggctgcctcggctatggaagttgtgtgaaggcatgtccttttgattcaatccatgtggttgacggagttgcatgcgttaatccgcttacatgcaaggcctgcggcaagtgcgtagaggcttgtccaaagcacctcatcgagcttattccatatgacacaaagcacgttgtaaagtgcagctcaaaggacaagggcaaggatgtcatgaaggcatgctcagtgggctgtatcggctgtcatctgtgcgagaagaactgtccgtcagatgctgtccatgtagtagacaatgtagcttatattgatcaggagaaatgtacaggctgcggaatctgcgcagagaagtgtccaaagaagattattctgtaatgaataaaagctgtcacatatcattatgatatgtggcagcttttttataagctttaggcagctattctttgcttacgttatactcatctgatgtcgtgataatactataatcatctgtcacaaatattgcctcaacaccggaaagggaatttataagctcctttgctttatcaatgccaagagcaaaacatgtggtgcttaaggcatctccgtcgcaggaggagtcgcttatgatggtgacagagtacagattgtttttgacgggatagccggttgttgtgtcaagtatatggtgatatagcttgccatctactctgtagtaccgctcgtagatgccggaggtgacgacggatttgtccttgattttgacagtgcatatgggctcaccgctctcgtcgaagggcttttgtatgccgactgtataatcacttccgtcggatttttcaccgacggtgaggacattgccacccaggtttatgatgccggaggtgatttttttggactgtaaataagctttcatcttatcggcaataaagcccttagcgattccaccaaggtcaagctttgcttttgaatcggttagcatcacatcgtttccgttaatctgtatattgcggtaatttacatgtgacagctcgctttgtatctgcgcatcagacggaacgactgatgcatccacctcattatctttagagtcggtattttcagctatttctgaaaaattccacaaatcagacagctttcctatagtaatatcaaacctgccgtcacttgtgtcgccgtattcgatgcccttttttatgagctcaagtgtatcatcgcttactgtgacatattctttgccggcagcgtcatttattttgctcacctctgagtaactaactgtgtttgaaagcatatcctcatatttctttgctatatcaaagcagtcggctatgtatttctcgtcggtagtgccataaagcgtaatctgtattatcgtgtcaaagtagaagccctgttttgaaaccttctgctgagccttgggctttaattcacatgcagacagacttcctgttattgtggcaagcgccaaaaggacagggacaaggtgttttagtttatttttcataatgcatcctttattaatttcctggttgtaaattatttatagttaaagcttaaatagtaaaagcataaatataactttgcgtccgggctttatgaaatttaaaaccgaaagcaacagaaatataataacacaaaataaaaaaatgagacagtagtaaaaatgattttgtattttgtatgaatatatggtaaagtagtaaatgtatgcgtaatgtaattatgtatgcatttagacttacaataggaaagatgatagaaatgagttttttggacaattataaaagagtggtaataaagataggttcatcgacgctgacacatgcagagacgggaagcctcaatttttcaaagatggagcgtctggtgcgctcgatatgtgattacagaaacagcggtatggatgtgtgcctcgtaagctccggcgctatcgcggttggacgtgatgtgataggcataaaggagcgcccgagcgacatttcaataaagcaggcatgcgccgcagttggacagggcaggcttatgatgacatatcagaagcttttttccgagtataatcagaattccggacaggtgctcatgacaaaaaataccatagtcaatcctgtttccagacgcaatgttatgaatacatttgaggagctttttgatctgaacgtggtgcctattgtcaatgaaaatgatacggtaagcacatatgagatgcagtttggtgacaatgatacgctgtctgctatagttacatcgatcacgaaggctgatctgctcatactgctatctgatatagacggactgtattccgacgatcctcatgacaatccggatgcaaagcttatcagagaggttgatacgcttgacaggaaaatacttggcatggcaaagtcatcaaccggcagcgatgtcggaaccggcggcatggcgacaaagcttacagcggcaaagattgccacatattccggggccgatatgattatcgcaaacggcggcaatatggggattttatatgacattatgaatgacagatatacaggaacacttttccacagggcaaaggatgcagggtttgtgcttgcggattatatacaaagagagatggcacctacatctacaggcggccagtaatcagctataaatttgaaatcaggagagtgctatgacacaggaaaaaatacagcgaatcaatgagctttacagaaagtcacaggcagagggactttctgaggcagagaaaaaggagcaggatcttttgcgcaaggagtatatagcaaacgtgaagaagaatttaagaaaccagctcaacaatatcgatatggtaaacgatgacggttcggttgagaatctcggcgagaaatatggaaacaaaaaaagaaattcgtagcaagcttaaaaagcaaagaggccttctgggggttgatgagtgccacaacatgagccatgaaatttataaaaggctcatagctttagagctcgacagggaatatgacaacatacttttgtattcagctatcagaaatgaagtgaatactgatgagtattttgcctatttaataaacaaagcaaaaaggatatattatccgagggtttcgggcaatacaatgtccttttacagggtaagaagccttgatgagcttaattgtggttcatttaatattaaagagcctgatatgacgaaggagtatacgcaggcggatggcagggcgcttatgatagtgccggggcttgcattttcggataccggttacagaatcggctatggaaagggcttttatgacagatatttatcgtctttcacaaaaagagacactgttatggcagttggagtgggctacgatttccagttacttagcggcatgacgtttgaagatgaatatgacgtacccttagatggggtgataacagataagagagaggtgtttattgatgaatgatttagaaaaaatttgtgcggatgcatatgaggccagagtaaagataggaacactggatactgatatcaagaataaggtattaaacgatgcagcggacaatcttcttaaggcagaaaaagaaatccttgaggcaaacaaaagggatgtggccacagcagaggaaaatatgaaggcaaagagcatgattgacaggctctcgcttgaccatgacaggctccttggcatggctgacggactcagacagatagcaaagcttgcagaccctattggggaagtgatgtctatggcaaagcgtcctaatggccttattatcggaaaaagaagagttgcaatcggtgttgttggcattatctttgaggcgcgcccaaatgtcacatcagatgcctttggtctgtgctttaagacaggcaactgtgtcatattgaagggtggaagtgatgcgataaataccaatatcgcaatagtaaaggctttaaaaaaggctttaacggacaatttggtttctgctgctgcacttgcacttattgagtcaacagacagagagacaacaaatgcatttatgaagatggatcagtatgtggatgtgctcataccaagaggtggtgcaggactcatacaaaatgttgtaaaaaatgctacaattcctgtcatccagaccggtacaggcaactgccatgtatatgtggacaaggatgcagactttgatatggctgttaagattattaacaatgcaaagacacaaagaatcagtgtctgcaatgcatgtgagtcgattgtagtacacagtgccatagcggaggagtttctgccaaagctgtacgataagctaagagaacatcatgtacagctgcgttgtgatgaaagagcacaggctatactgaaaggaagagatgatgtgacagaggccactgccgatgactggggtatggagtatcttgattacatcatgtcggtaaagattgttgacagtattgatgaggcaatcgagcatatcaacagatacaacacatcacattcagaggcaatcatcacaaatgattatgacaacgcacagaagttcttaaatgaaatagatgctgcatgcgtttatgtaaatgcctctaccagattttctgatggaaatgaattcggctttggagctgagatcggaatcagcacacagaagcttcatgcaaggggacctatggggcttgaagcactgacaagctataagtatattatttacggcagtggtcagatcagggaatagtcaggtaaagtatcatagaattaatttgagaggaaacataatataacatgagctacgatatagatataacaaagacaccaccggcacatgagcctgagaggcagtattactacatggaaaaggcaaaggattttgttgaaaagaaatctaaagaaatcggccgtcctatgacttattttgtaaagacattcgggtgtcagatgaatgcccgcgactcagaaaagcttgtcggaatactcgagcagataggctacgtggaaggaactgatgagcactctgatttcattgtatacaacacctgtaccgtacgtgagaatgctaacaacaaggtgtacggcagacttgggtatctgcagaattacaagaaaaagaatcctctgatgaagattgctctctgcggctgcatgatgcaggagccggaggttgttgaaaatatcaaaaagcactataagtttgtagatatcgtattcggaacccacaatatattcaagtttgcagagattttgtgcaacaatatcgagtctggctcacaggtgattgacatatggaaggataccaatcagattgtcgaagatctgccggtgaagagaaagttctctttcaaatcaggtgtcaatatcatgtttggctgcaacaatttctgcagctactgtattgtgccatacgtaagaggtcgtgagagaagcagggagcctaaggatatcataagagagatagaaaagcttgttgcagacggagtgtgcgagataatgcttctcggacagaatgtcaactcatacggtaaaacgcttgacaatcctataacctttgcagagcttcttcgcgaggtcaataagattgagggacttaagaggattcgttttatgacatctcatccaaaggatttatccgatgacctgattatggcaataaaggagtgcgacaaggtgtgcaagcatatgcatctgccgcttcagtcaggaagctcaagagtgcttaaggagatgaacaggcactatgacaaggaaaaatatctcgacgaggtaaagagacttcgtgagcagattcctgatattgcaatcacaactgatatcattgtgggcttcccgggagagactgaggaggatttccttgagacaatggatgttgtcaagcaggtcagatatgacagtgcttttacatttatttactcaaagagaacaggcacacgcgcagctaccatggagaatcaggtgccggatgatgtggttaaggacaggtttgacaggctcttaaaggaggttcagactatctcatcagaaaaggcaaaatgctatgagggcaaagtggtgccggtacttgcagaggaaatggacgaccagaaggacggctatgtgaccggacgtatggacaataattcaatcgtacattttccgggtaccgaggatatgattggaaatatctacaatgtgaagcttgatgagtgcagaggcttttactatatgggagagataaaagaggatgcgtaagcgttttggcagaaatgatataatcctgatatcggttattgtaattatctctgtcgctctgcttcttatatggaagcttgtatatttaaagggacaggatacggatagcgatgcatgtgtcgaggtgactatcgatggaagggcctatggcacatatccgctttcaaaggatgatacaattgagataaaaaacggcgatggcgatattactaacacccttgtcataaagggcggtgtggcagatatgacctctgccgactgtccggatcatctgtgtgtgaagcagaaggcgatatccaaggagggagagtcgattatctgtctgccgaataaggttgttgtgacggtaaaaagcgacacgaaatccgatatagattcgatatccaagtgatacccgaacatttttatagaaagaatgagataaatgaaaaccagaaagattgcatatcttggtatgcttatggcactggcactggtgctaagctatgttgagtcacttataccgtttgcggtaggcataccgggagtgaagcttggacttacaaatatagtgacagtaatcatgctttatatagcagcacccatggagacatttctgctatgtgtatttcgtgcggtgctttcaggatttatgtttggaaatgcgttcagcatcatatattcactggcaggctgtatactaagctttatcgttatgtacctgcttaagaaatcagataaattcagttcggtttcaataagcctggtcggtggagtgtgtcacaatataggacagataatagttgcggctatagttttgtcaacctacagcgtagtgtattatattccggtgcttcttgtggcaggatgcatcacgggacttgtgattggaatagtagcttcacaggtgcttttaagaatttctgacagctttcatgtatagttttaatgggctgtaatctacgtatatttaataacaaaaggagatgctgctgtttttatgcctgtgtgtcaggctacagtcgaaacagtaacaaatggattcaatgtatgcatatataaaaggagagcttgcagaaaaaaatatagacagcattgtagtggaggcagcaggtgtaggctatctcatttacataccgacgcagtattttgatatgctgcccgacgagggagaggatgtaaaaatttacacctacctatgtgtcagggaggatgccatgatactttacggttttttgagcaaggatgatcttgaaatctttaagctgctgattacggtcagcggaatcggaccaaagggcggccttgcgattttgtcaactctgcctgccgatgatttacgttttgcgattctatcgggcgactcaaaggctatatcaaaggcaccgggaataggtgcaaagacggctcagagagtgatacttgatttaaaggacaagctgtcgcttgaggatgcatttgaaaagaagcttgagaatcagacttccggtgctgctgtatccatgaacagcactgtgaaaaatgatgctgtcatggcgctcaatgcgcttggatactcatctactgagagtcttaaggcagtgtccaaggttgatatcacagaggatatggatgtagaggatgtgctgaagcttgcgctcaaaaatatgggctgattgataaaagctgtaagcttaaaacagaaacggggaacaaaacgtgaaaagagtaatttccacacaattgcaggaagaggacataaagatagagaaatccctgcgtcctatgtattttgatgactatatcggtcagcagaagataaaggacaatttaaaaatatatattgaagccgcaaaatcaaggggcgaagcgcttgatcatgtgctgttttacggaccaccggggcttggaaagacaacgcttgctggaatcattgcaaatgagatgggtacaaagataaaggtgacctccggtcctgcaataggtaagccgggagagatggcagccatactcaacggactttctgagggagatatactgtttgtcgatgagattcacagattaaaccgtcaggtggaggaggtgctctatcctgccatggaggattacgccattgatatcatgattggtaagggcgagtctgcaaagtcaatcagattcaacctgcccaaattcacccttgtaggtgcaacaacgagggcgggcatgctgtcagcgcctcttcgcgacaggtttggcgtggtaaatcacatggagttttacactgtcgatgagctaaagcatattatcgtcaattccgcaaaggtgcttggagttgagatagatgacaagggagcctacgagatggcgcgtcgttcaagaggtaccccaagacttgcaaacagactgctaaagcgtgtcagggattttgcgcaggtcaagtatgacggcaaaatcacctatgatgtggcaagctttgcactggatcttttggaagtggacaagtatggacttgatttaaacgacagaaatatacttctcaccatcattgacaagtttgcgggaggaccggtgggccttgatacgcttgcggcggcaataggtgaggatgccggaaccattgaggatgtttacgagccgtatctggtgaagaacggcttcataaaccgcacaccaaagggacgtgtggcaacagaactagcctttgagcattttgagagaaaaagggcttaaagttgcaatttatatctataaggcatataataattaagtatttgatattgaaattgatattaatattaatattaatattaatatagctggtttgaataaatgtgaaaacggaggatgattaaatgtctgcaaaaacaaatgccgaggtggtaatagatggaaaggtttacacactgtcaggatatgagaatgaggaatacttacagaaggttgcggcatacatcaacaacaagattgcagagtttgatgatatggatgagtataagcatcttccgggtaatatgaagagcacacttatcgagctcaatattgcggatgattatttcaaggcaaaggcacttgtcgaaaagctcgagggtgatatagagaataaggataaggaaatatacgatttaaagcatgatttaatttccaatcaggtaaagaccgagaatgctgaggcaagcatgaaggagcttgaggcacaaaacaaagagcttttactcaacaaggcgagacttgaggcaactcttgaggagtcacttcttgatggaaaaaagcctgttaaaaaatctgcacatgcttctaaaggggcaaatgacagtagcgataaatagcaataaaaggggaacagttatcgtacactgttccctattttattgcaggtttatatgatatcaaatgagcatctatatgaggaaatatatgagaaataaagattttgaacttcttgcaccggcaggcaaccttgagatatttaagggcgtgatagaaagcggcgccgatgctgtgtatgtgggcggaagcatgtttggagccagggcatatgccaataattttacagaggatgagcttttagaggcaattgattttgcgcatttacgaggagtaaaggtgtatctgacggtcaatacgctgattaaaaacagtgagttttcaaagctctacgactacctgcttccatactacaaaagagggcttgatgcagtgatagtgcaggatattggagtggtgaaggctatccatgagtattttccgtcattggagatacatacgagtacacagatgacggtaacgggagcagacggagtgcgctttctttcgcagtttggagtgacgcgtgtggtcatggcaagggaggtttctcttgccgagatgaagcgcatacatgaggaaacaggcatggagcttgaagcctttgttcatggagcattgtgctattcgtattccggacagtgcctttttagcagcattttaggtggtagaagcggaaacagaggccgctgtgcacagccgtgcagactgccgtataccgtggagggcaaaaaggatgaatacattttaagccttaaggatatgtgtggtataaaggctcttgacaagctgcatgatgcaggcgtttattcgctcaagattgagggacgtatgaagcagcttgagtatgcatgcggagtggtaaaatactacagaagctatatcgacagtatgaagcctgttaccgatgctgattatgacaggataaaggcgcttggaaaccgctgtggtttcacagacaggtattatttcgaccacaatggctctgatatggtgacttatgtgaagcctaatttcgtttcaaatgctgcagagccttcgcctgaaaaaagaaagctttcgatagagggagagcttgttttaagagagggcgagcccggaagcctcactgtaaaaagaggtgatgtgacatacaaagcctcaatagaacctgtcagtgccgcacttaaagcaccgcttgataaaaaagccgctatcgacaggataaacaaaaccggtgatacagactttgagttttcacatattaaagctcaaatcggagaaaacgtctttgtgccaaacggagcactaaacaagctgcggcgtgatgcaatttcagggctttgtgataagctgttgaaaaagtattacaggaatgatgcacgatacgctgatatgtcaagacttacagcactccctgagcatgtcgtaaaaagtgatgcagcacatgatgaagctataaatgattacaccaccatatgctcgtgtataacacgcgcgcagcttgatacacttattggctatgactgctttgacgtattttatctggattttgacatgtatgacaggaagactctgatacagcagtttgcagatgatgtgcaaagccttacaaagcgaaataaaaaagtgtatctcatgctgcctacgatattcagggcggattcatctgattattttgtatctatcgcaaaagagcttgataaggtaagctttgagggctttgtggtgaaaaattacgaggagctttatctgacagaaaatttgtttacagggaaaaaagttattttagaccacaatatgtatacctttaatgatgtttcaaagagtgctttttttgagcacggagtaagtggtgatacagtgccgcttgaactcaattcaaaggagattatgcatagaaacaatataggctcgcagatgatagtctatggatattatccgcttatgaccaccgccaactgtgtgcacaaaaacacaaagggctgtgataaaaagcaaaagcttatatatttaaaggacagatacaataaatcctttgcagtttgtaacaactgtaaggagtgctataatacaatatataattcactgcctaccatgctcacaaagaacataagtaagcttaaggaggcaggtataagaagttttagatacagctttacaatcgagactccaaagcagattaaggcggttatggatgataaggtagctgaatatacaaacggacattacaaaagaggagtagaataacatggtacatctgatagtacagctttccaagtatattatgataatactttttctcatatatacttttttatgctttcatttattcaagtatcccgacaagccgaaaaagcagaagcatatatataatctgcagagattttatatgtttctgattcatttagatggttttttggtgctctttgtcacgacaatggatacaaagataataggattttatatagcacagcttgtgctttttgaatcaatttatttgatttatcataagttttataagaatgcctcagagcttgtgctaaacaacatggtgatgatgctttgtataagcatgattattctaacgagaatttcgtttgacaaggcattaaggcagtttgtttttgtacttgccggaacgatatttgcgtttttaataccgcttatcatgcaaaaaggcacgatgtttcgaaaactgacatggacatatgccggtgtgggaatagttggactcttgtcggtgcttgtggtaggagtggcgagcagaggagcaaagctttctttgacatttggtcctgtttcaattcagccatctgagtttgtgaagatactttttgtgttttttatagcatccatgctgtataaatcaactgatttaaagcagcttgccataacaagcagcgtatcggcagtgtttgtgctgatacttgttgcatcaaacgacctcggtggagcacttttgtatttctttacatatctggtcatgatttatgttgctacaaaaaggttttatatttttgccggaggtcttgcgtttgtggggcttggaatgtacgcaggctatcatctgttttcgcatgtgaagaacagaattgttgcatggcttgatcctctttctgttatagacaaggccggctatcaggtgtgtcagtcgctctttgccataggtacaggcggactgtttggttttggactgggacagggactgccaaataagatacctattgtgtcaaaggactttatcatagcggctatctcagaggagatgggcggtatatttgctgtctgcctcattatggtttgtgtcagctgctttcttatgatatttaatctttccatgcagatgaaggatgcattttacaagtatgtggcgctgggacttggcagtgtgtatgcgcttcaggtgcttttaactgtcggcggctcaaccaagtttataccgatgaccggtgtgacgctgccgcttgtgagctacggtggcagctcgcttctatctacgatgattatttttggaatgatacagggcatgtatattatgcaggcagcccctgaaaaaaggagaaatatagatgacaagagacgaaaggaccatgagacaaaaaacagacaaaagcagacagctaaagagccgggggcgcagggaagtcaacagagaaggagaaaaccggcagcaggcggcaaaaacagcacgaagacacagaaatagagagtatgcggttgttacatattttttccttatagtttttgttggattgataggttatttcttatatttccagtttgtaaaaagcgacgaattcatcaacagcccatacaattcgctgcaggatcttttctctaagaatgtagtgaggggcgagatacagactaaggatggacatgtcatagcacggacaaatgtcagctcggatgcatctgagacaagggaataccctgacggcaagatgtttgcgcatgtggcaggctttgccgtaaacggtaaggccgggcttgaaaagcaggaaaatttctcattgcttcgctcacatgagtttttccttgaccagatagtaaatgatataagcggtaagaaaaataccggtgataatgtcataaccacactggattacgaagcacaggcggctgcatacaatgcacttgacgactatgaaggtgctgtcattgcaattgagccgaagacaggaaagattgcagttatggtgtcaaagcctgattatgacccaaacaccatagcaagtgactgggagagcgtaaacggtgagggcagcacttctctttacaacagggcaacacagggacagtatgctccgggctcagtgtttaagatttttacagcacttgagtattataacgaaaatccgtctacatacaacgactacagctttgattgtgacggcagtattacaaaggacggctttacaatccactgcgccggcaataaatcacacggacaggaggacttaacaaagtcgtttgccaagtcatgtaactcgtcattttccaatataggtcttttggtggataacaataagcttaataccttgtgtgacgatatgcttttcaacaagaatctgcctatagcctttgattcaaaaaagagtaaatttgcactggataacaatgcttcgtcagctctgaccatgcagaccacgataggtcagggaaacacgcttgtttcaccgcttcacatgtgcatgattgccggtgcaatctgcaatgatggaaatctgatgagaccatatctggtagaccatacggaaaatgcgagcggggcgcttgtggagcagaataaaccggcttcatacaagcagattatgtcaaaggatcaggctgcttttcttcagaatcttatggcagcagtggtatctgatggaataggcgcaaagctaagcaatcagagctatgaggcctttggaaagaccggaactgcccaggtatcggattctacagaccagaccaatgcctggtttgtgggctatggaaaaaaggatggctacaatgatctggcaatcgcagtaattgtggaggattcgggtgccggaagcacatatgcggtgccggtggcaaaaaaggtatttgataaatatttcaatgaataggcttgttgcactttttttagaagtaggttatacttaagtgtaatgacagacgttatcgttcatatttcgcttgaactgacagatagcgtttaaaccacacttggaggaatggcaatgatagaagcaacgagctgtggcggtgtggtaatctttcgtggcaaaatattactcttatacaagaactacaggaacaggtacgaggggtgggtactgcccaagggaactgtggaatctgatgaagagtacaaggacactgcaatccgtgaagtgaaagaggagactggtgccagtgcaacgataatccaatacgtgggtaagagccactattcttttaccgtgccacatgatacagtggaaaaggatgtacactggtatcttatgatgggcgaaagttattatagtaaaccgcaaagagaagagtatttcatggattcagggttttacaagtatcacgaggcatatcatctgctcaagtttgcaaatgagaagcagatacttgagaaggcttacaatgagtacctggatttaaagaaaagcaatttatgggggacacacaagtattattagtattattaaaaagcagttttaaaaactgctttttgaggttttggaatgaaatggtatgaggatttatttgtaggagagtctgttaccggaaagataaagaaaatcaagtggaagatagagcataatgccggcatgcttcacacatacatcatcacgtttccgtcaaatgaggaaaatcttttggatatcattccgacaagagaattgctgcaaaagggatatccgaagaagaatctgcacataatcgcagtagcgggtaattatgatgaggcacttttgctggcctgtgatattgttaaggagacctacgaaaatacaggtaaaacagatgtgaagagctatttaaagagcaaacggaggaaatagatagatgatatttacgattttaaaggtcataggcatcatactccttgtagtgcttgctcttatacttacagcgctgctttgcgtactgtttgtgccggtcaagtacagggctgtcggaagctttgacaatacagacataagagcaaaagcacatgcgtcatggctttttcatttgtttgcacttcatatagagtatgcacaggagactgacggatatataaggtttgcttttgtgaagaagaagctgtttgataattatgaggctttggatgatgacgatatggatgaggcagctaaaactgaaacagaagataaagtcagtgaaaacaccggagatgagcctaaaataccggcagatgagtcagaacatgtcgcagatgaacagacagagaatgaaagcacagcacagactcataatgagcaaaggacagtaactgatgagaatcagcatataaaacaacaaaccaagctcactcatcaaaaaacgtataaaaagccacataaaaagcaatttaaagataagtcagaaaaaataaaaaactgtatctataagctaaaaagagaatacagtgatgagagaaataaagccgcttttttacatctgaaaaaagagctttttatcattcttaaaagaatatgcccaaggaggcttaagcttacaatggtttattcaaccggctcgcctgatacaacaggtatttcattgggaattttagcatgttttcctgtcggctatacaaacagatggcggattacacctgatttcgagagtgaaaagccgtatgcaaagggcagctttgatataaaggggcatgtgatagtaataagtattttagcggcaacacttagaattttatttgataaaaactgccgcagattatataatagggtaagcagataggaggaagatattatggcagataatagtttcaataacacagtagagtcacttttcaaggggatggacagctttatcactacaaagactgtagttggtgatgcgattcatataggggatacaatcatacttccgcttgtggatgtgtcgtttggagtggcagcaggagcattttcggcagaaaagaaaaataacggagccggtggtatgggcggaaagattcagccaagtgcagtgctcgttatccagaatggacagacaaagcttgtaaatgtaaagaatcaggacggcatgaccaagatacttgatatggtgccggacattgtaagccgcttctcaaagggaaaaaatgatgaccttaatctcgacgatgtaaaggtagacgaggcagaggacgataagcaggattaatttcatatatgtgagcaaataaaaaggacatccaaacggatgtcctttaaaattcaaaagattcaaaaataaagactaagctctctcaactttgccagatcttaaacatgaagtacatacatataacttctgtggaactccattgaccttgcaagaaaccttcttaatgtttgacttccaaacatgatttgatcttctatgagaatggctgacattatttccataatgaacacctttttcacaaattgcacattttgccatgatattgcacctccttgcatttcactaagcttaccatactcttaagctcacaacaaatgtattctatcagattaaaataaagaatgcaaggataaaatataaaaatatttgctttttgtgaaaaaaaaggtataataacattagctacgtcacaatatgatggaggtatatattatgaagggacagatggatacccaatatggacaaattttaattgatacagatgttattgcaacctatgcaggctctgtagctgtagagtgctttggaatagtaggcatggcagcggtcaacatgaaggatggtcttgtaaagcttttaaagagagattacctgaaccatggaataaatgtaaaggtagatgagaacaacgaaattaccattgattttcatgtaatagtagcgtatggtatttcaatcggcactgtttcggacaatcttatcgagacggttaagtacaaggttgagtcatttacaggaatgaaaattgcaaagatcaatatttacgttgagggcgtaagggtaattgattaaggaggactacaaaaagtggagatcacaagcattaattcaaagctccttgcaaggatgtttcttgcgggagccaagaatcttgattcaaagaaagactggataaatgagctgaatgtattcccggtaccggatggtgataccggaacaaatatgacaatgacaatcatgtctgcggccaaggaggtcagctcgctcacaaatcctaccatggcagagcttgcaaaggctatttcatcaggctctttaagaggcgccagaggaaactcgggtgttatcttatcacagcttttcagaggcttctgcaaggttataaaggaatacgatgagatagatgtcactattctttgtgaggcatgccagaaggcggttgagacagcttacaaggcagtaatgaagcctaaggagggaactatcctcacagtggcaaagggcgcagcagaaaaggctctggagctgtcagacgaaacagaggatgttgtcacatttgttgaagaggttataaagcaggctgagtatgtgcttgaccagacaccggagatgcttcctgtattaaaacaggcaggtgttgtggattcgggcggacagggacttgttcaggtgttaaagggagcatacgatgcccttatcggcaaggagattgactatacaatagagggcgcaccaacaggagcagctcctgcaaagatttcggctgagacagaggcagagattaagtttggttactgcacagagtttattattgtactcaatgcgccaatgtcagacaatgaggagcacgcatacaaggcattcctcgagtcaattggtgactctatagtcgttgtagctgacgatgagatcgtaaagactcacgtacatacaaacgaccctggacttgcactgcagaaggcacttaccttcggctcactcagcaagataaagatcgacaatatgcgtgaggagcatcaggaaaagctcatcaaggattcacagaagcttgcagcacagcagaaggctgaggaagaggcttatgaagctgctcaggctgatgaaaagacaaataacatgcctgcaaaggaaatgggttttgtatctgtttcaatcggagaaggcatgaatgaggtgtttagaggccttggagtggactatctcatagagggtggtcagaccatgaaccctagcacagaggatatgcttaacgctatcgagcatgtaaatgcgaagacagtatttatcctgccaaataacaagaatatcatcatggctgcaaaccaggcagtagaccttgttgaggataaacagattattgttatccctacaaagactatcccacagggtatcacagcactcgtaaattatatccctgaccacagtgccgaggagaataaagagcagatgatggctgagatagaaaatgtcaagacaggacaggtgacatatgcagtccgcgatactgagattgacggaaaaaccatcaagcagaacgacttcatgggaatcggcgacaagagcatcctttctgttggaacagacttaagggctaccacacttgagatggtagatgccatggtagatgaggattcagcgattgtcagcatctatttcggaagtgattctgatgaggactcagctaatgagcttgcagcagcaatcgaagagaaatatcctgatgtagaggtcgaggtcaacgatggcggacagccaatctactattatgttatttctgtagagtaaagccctttaaagaatataaatgatatttattatatttaggagcaaatatggatatagcttcaccgattaccgcggttaagggaatcggggaaaaaacacaaaaagcatttgctaaaatgggagtatacaccgttggtgatatactccttcattttccccgggattatgtaaagtttccggaaataacggatattgatgaacttaataatgtaaacgtaagcagcacctatgccatccatgctgtgattaaaaaggcacctgtagtgaaaaatacagcgagaatgcagattacattgcaggatatcggctcgccagggcatatgatacagctgatatggtaccgtatgccataccttaaggcacagcttgtgcaggggagacatcttatattttacggacatattaagccaaagggtggcagatatatcatggagcagcctgtggtgtatgaggtgcaaaagtacgaggctatacgtgatacgctgcaacctgtgtattccgtgacaagcggtgtgacaaacaatctgatagtgaagacgataaaggagactctgtcacatgatacactgctgtcagattatctgcctaaggatataaggcacaggtacggcttttgcgagtacaattatgccatgaagcagatacatttccctgatgactttgacgcgcttgtggaggcaagaagacggcttgtttttgatgagttttttctctttatcatgggcatgcggtatcagaataaaaagcagcagaaggacaaaaatgagtttgagtttacggatgatgcttttatagacggactgattgataagcttccgtatgagctgacaggcgcgcagaagaagacaatagatgagataaagcaggatattaaaagcccttatgtgatgcagaggcttattcagggtgacgtgggctcaggaaagacgattgttgcttttcttcttatggcgtgggcgtcaaaatgtggctatcagtctgcaattatggctccgacggaggtacttgcaaaccagcattacgagacgttttgctcactggtcagtcagtttggacttgacagtcctgttgtgcttcttaccggctccatgacggcaaagcagaaaagagaggcctatgagcgccttgaaaacgagaaaaatgcgcttattataggcactcatgcgctcatacaggagaaagctgatttttccaatctgtcgcttgttatcacagatgagcagcacagatttggagtgaagcagagggagagcttctcggataagggaagaaagccacatatacttgtgatgagtgccactccgataccgcgtacgttagcaataatcatatacggtgatatggatatctctgtcataaatgaggtgcctgcaaagagacttcccatcaagaactgtgtggttggcacggcattcaggccaaaggcctacagcttcatcgaggagcaggtgagagccggtcatcaggcgtatgttatttgccctcttgtggaagaaaccgaaaactcggaaggggaaaatgtcacagactatgcaaatgtgcttaaagcggcactgccaaaggatatcacggtagatgtgcttaacggcaggatgaagagcagggcaaaggatgaggtgatgcagcgctttgcaaataatgagtcgcaggtgcttgtgtccacaacagtcgtggaggttggtgtaaatgtgcccaatgcaactgttatgatgatagagaatgcagacaggtttggacttgcacagcttcatcagctaagaggccgtgtaggcaggggggatgcacagtcgtattgcatttttatcaattcgtcaaattcaaagaagtcaaaaaagcgtctggagatactaaataaatcaaatgatggcttttatatagcaagtgaggatttaaagctcagaggtcccggggatttctttggaatcaggcagagtggagaacttgcgtttgctcttgcggatgtgtatcaggacagcgatgtgctaaaggaagcatctgagatggtggatgaggtgcttgaagcagacccggcgctttgtacagcggaaaacagaatactgaaaaagaaaatggatgaatttgcaaaagaacaattaaagaggatgaatctgtgatgagcttaaatggctaaaataaaagctgatatcgcatgcaggactatgcatgtgtatatcagctttttactttaagggttttggaatggttatgaaattgttatgaaattgttatgaaataagtataatctgcttactcaatctgcctgatatcggatatgtccgggtgaatcgtgagagaatagtttgtgtaatacacgacaaagccggctgcggcaccgtttggctttttgacatttttcttttgcagataatctatctctaccttgtcggcatttttgccctttgagtagtagcctgcgagcttgccggcctcctcaaaggtgctgtccggcagctctttgttttcagcttttacaatgacatgtgagccgggcatgcccttggcgtggaaccaccagtcgtttccggttgccagcttgaaggtgagctcatcgttctggtagttgtttttgccaacgtacatatcaaagccgtctgatgagatatagtggaagggtttgctctttaccttctgtttctttgaaccctttccttttttgataaaaccgtattctatcagctcatcctttatctggacgaggtcgtcagcacttaaagcgatatccagtgaattctgaattgattcgagatggtctatctgaccttttgtttcaagaatcagctcgttcaatgcctcggcagtacgtttcatctttccgtatttgtcaaagtatttctgcgcgttctcggcaggagtttttgtgttgtcgatagggattttgatgattttgttgtcatcataatagtttgcagcttcaagaaacttgtcgtccggtgtaagtccgtagccgaatgcgttgataagctcgccgtataccttgtacttttcgcgtttttcggagtccttaagctgcttcatctgcagggaatatttcttctggtttcgctccaggagggtatttacgtgttttctcaggtcggctgacttctggcgtatacgtgtataggcgtttctctcagagtagtaaagctctaaaacctctgatatggattcatattttgtgaccgttaaatcgctatactgagtcagctctattgaagaaaattcctttggttcattgccgtcacgcacgatattcggcgtaaaacgattattttttatgtcctccatcatccatgtgaagttgcttctcaggtgcaaaagctcatcgtgtgagtaggcagctaccggtgcgtcggcgtcaaggcctgccctgtgagccagctcatttgccgcaagggggctgatgcctgaaaaggatgagtagatagcctttgaaacagtaagcggctttactgatataatatccacaaactgcttcgaatctacagtcagaggattatatttatcctcctgtgttgcggggatggtgtaggctctgcccggaagcacctcacgcacagagcttacggatgcgggaatacgcttggcactgtctattatcgtaccatcggagtcggtaaagatgatgtttgaatatttgcccatcagctcgataataagcaccttgtgacatagatcgcccatctcgtttaagtgctcgatttcaaagtttatgatacgctccatgcccggctggtaaatctttgtgatgcgtccgtttgctatatgctttcttaaaaccatgcaaaatgtaggggcagtgagagggcttaccttatttgtggatgtcaggtagatgaatggaagcgatgcacttgcagacatcgaaagcctgaaagagccgtttggcccctttagggtaagaagcagctcatctgcctcaggttctgcgattttactgatttttgagtttagtatcgtgctgtttagctctgcaactatatttgaaatgactattccatctaaagccatgatgttcctccttatttcctgtaaatattctaagctgctgaatatttataatcatgaatatttatattataatatatttgacgaaaatctcaaggagttatataataaactcatctatgcatatgcgaaaggaaaaattatgattaaaagtatgaccggctttggcagatacgagtacgcagatgcaagccgtaagattacagttgaggtaaaatctgtaaatcacagatatctggatgtcaatatcaagatgcctaaaaagctcaatttcttcgagagtgcaataaggactctgcttaaggagtacatagagcgaggcaaggtcgatatttatatcacatatgaggattttacagaaaataatctctcattgcagtataataaggctctcgcgggagaatatcttaagtatctgaatcagatggcggaggaattcggactggagaatgatataagagtgagcacgctgtcgagatatcctgaggtatttgcgatggaggagcagcctgtagatgaggatgagctgtggagcagtcttgagaaggctcttcgcggtgcatttgagccatttgttgaaagccgcgtgcgcgagggagaaaatcttaaaaaagacctttgcgaaaagctcgataatatggtatcatatgttgatttcattgaggagcgttcgccacagattattatcgaataccgtgcgcgtcttgaggaaaagctaagagagctgcttgcagacaatcagcttgatgattcaagaatagcccaggaggtcactatttttgcggacaagatctgtgtggatgaggaaacagtcaggctcaaaagccatatcctttccatgaaggattcactaaatgccggtggcagtgtgggaagaaagcttgatttcctcgcacaggagatgaaccgtgaggcgaataccatcctttcaaagtccaatgatcttaagatttctgacacaggcatcagtcttaaaactgatatagaaaaggtcagggaacagattcaaaatattgagtaattttaggagattgtgatgagtaacacaggaaaattagttgttttttcaggcttttcgggttccggaaagggtactatcatgaaggaacttatggcaaagcatggtgatgattatgcactgagcgtatcagccacgaccagaggtccaaggccgggtgaggagcatggcagagagtatttctttatctcagaggaagagtttgaacagatgataaaggcagatggactgcttgagtatgccaagtatgtagatcattactacggcacaccaaagtcatatgtcaatgagcagcttagcgccggaaagaatgtgattcttgagatagaaatccagggagctttaaagataaagaagcagtttcctgatacggtgcttatgtttgtgtcagcgccgagtgcagatgagcttagggaccggcttgtaggaagaggcacagagacaaaagaggtctgtgcacagagactttcaagagcatatgaggagtctttgggcatagagaaatatgattatttagtggtaaatgataagcttgacgattgtgtagagcttgtgaatgatatcatccacagctctgacgacacaaaaaagaatcaggattatcttgtatcatcaaatatagattttataaataaaatgagaaaagagcttttaagcttttcgaaaggagataaataatatgatacatccatcgtatgtagagttaatgaaggtagtaaacaacaatgtagagataggtgaagagccggtagtaaacagccgttattctatcgttattgctgcagcaaagcgtgcacgccagattattgatggtgcagaaccacttatcgcacgccctaagtgcaataagccattatctattgctgtagaggagctgtacacgggagctgtcagaatcgtctcagatgatgaggatttaaacgaaggcgaagaggcttaatctaggagggggaaaggctgttttgtctttccctttaattgtaaatacttacatttgagaggtactatgaaattattatttatttcgcttggatgcgataaaaaccttgtggattcagagtatatgataggtatgcttgcaaatgacggcattgagatgaccgatgatgagacgcaggctgatatcattatcgtaaacagctgctgcttcataggtgatgcaaaggaggagagtatcaatacaattctcgagatggctcagtataaggagacaggcaaatgtaaatcacttattgtgacaggctgtctggcacaaagatacaaggatgagatttttaaggaaatcccagaggttgatgccatacttggcaccaattcatatgatactatagttgaagctgtccatgagacacttgaaaaacacagatacagcaatctgcacaccttagagggacttcccagcataaagacaaagcgtattgttaccacaggagggcatttcgcctaccttaagatagcagaggggtgcaataaaaactgtacctactgtgttattccatctgtcagaggccgttacagaagtgtgccgatggaggatttgattgagcaggcgaagagccttgtggagcagggggcaaaggagcttatacttgttgcccaggagaccacactttacggagtggatttgtatggtgagaagtcacttcataagcttttggatgagctcaacaagataagcgggctgttctggataaggattatgtactgctatcccgaggagatatacgatgagcttatagagtccatgataaaggatgagaaggtatgccattatctggatatgccaatccagcactgcaatgacgatattttaaggcgcatgggtagaaaaacaacaaaggctgagcttatggagcgtatcagaatgttgcgtgagagaatacctgatatcacactaaggaccacacttatatgcggcttcccgggtgagacacaggataatcacgaggagcttatgcagtttgtaaatgatatggagtttgaccgtctgggagcctttacgtattccccggaagagggcacaaaggcagctgcaatgcctgaccagatagatgaggatataaaggctgactggcaggctgatgtcatggagcttgaggaagaggtcatttttgataaaaatgagacactaaagggtaaagaattatatgttttcatagagggtaaggtggctgatgaaaatgcttatatcggccgtacatacagagatgcaccgaatgttgacggatatatattcatcaacactgatgagacacttatgaccggtgatatatgcaaggttatggtgaacggtgcgtatgaatatgatttgataggagaacttgtaaaatgaatttaccaaacaaacttacaatcttaagagtgatacttattccgttttttgtatttttccttatttcaccgttttttgacggatacggaaattatatagcacttgcgatatttatcattgcaagtctgaccgatatggctgacggaaaaattgcaagaaaatacaatcttgttacaaatttcggcaagtttatggatccgcttgcagacaagctgcttgtatgctctgcaatgatatgccttgttgatttaaagcttatccctgtatgggttgtgcttattatcattgcaagagagtttatcataagcggtttcagactcgttgcatcagacaatggaattgtcattgcagcaagctactggggaaagtttaagacaaccttccagatgcttatggttattgttattatttttaatatcaatctgcaacttggctggttaaatatccttggaacaatcctcatttatgtggcacttgtgctcacagttgtttcacttattgactatattgcaaagaataaggacgtcttaaaggaccagaaatagactataacagggagaaaagtatgagaataatagcaggaacggcgagaagcctccctctaaagactatcgagggaaaagatacaagaccgactactgacaagacgaaggagactctttttaatgtcatgcagtttgatgttcccggagcatattttttagatctgtttgccggaagcggacagataggacttgaagcgttaagccgcggtgcagcctatgctgtatttgtggagaattcaagaaaagccgcttcatgcatcgaggacaatatccattttacaaagtttgataaggtctcaaggcttatgatgacggatgctgtcacggcagtacgtactcttgagggcaaatacaaatttgatatcgtgtttatggacccgccatacaataaggagcttgaaaaggaagtgcttattacactttcggacagcgatatattaaaggatgatacacttatcgtggttgaggcttcaaacgatactgattttgattatctcacagagcttggctatgagatagtcaaagaaaaaatttataagacaaacaagcatgttttcataaagcgtgcataggagatacaatatgaaggtaggaatttatccgggaagctttgatccggtgacatttggacacctggatataatagagcgttcagccaaaatagttgacgagctggttgtcggagtactcaataatagtgcaaaaaactcgttgttttctttggaagaacgtgttagtatgataaaggaaatgacagcacatataccaaatgtcagggtagggtgcttcgaaggacttttagttgattatatgaagaaaatcaatgcaacaatcataataagaggattgcgtgcagtgacagattttgagtatgagctgcagattgcacaggctaacggagtgcagaatccggaaatagagacggtttttctcacttctagcctcaattattcatatttaagctctacaattgtcaaggaatttgcatcatacggaggagatatatcaaagttcgtacctgaacagttcattgatagaatttatgccaaatacaatattaccaggtaaggagacagtatttatgagcagtaaaatggaacagattattgaagaaatcgaagattatattgatggctgcaagccgtcacctatttcaagaaacaagattcttgtcaatcgtgaacagttagaggagcttctttcagagcttcgtacaaagacccctgaggaggtcaagagatatcagaagattatcagcaataaggaggctatccttgctgatgcacaggcgaaggctgatcagataattgcgcaggctcagattcagacaaatgagcttgtcagcgagcatcagattatgcagcaggcatatgctcaggcgaatgaggtagtgcagattgcaacaaagcaggcacaggagatacttgacagtgccacaaacgaagcaaataatctcagaatgagtgccatggcatatacggacagccagctcaagagcattgaggatatcttaacaggctctattgagacttcaaaggccagatatgacagccttataagttcactgcagcagtttgaggatgttgttgcagcaaacagagcagagcttttcccaccggaagagaatggcgatgaagctgcaggagcggagtcgtctgacaatgaggcagcttcagatacatctgatgatgacatagaaatcaccaatatttccgattcagatgaggatgcaaaataggataatacataacaggcatgagagtatgctcatggctgccttaagcagtatgtatctgtaaagcctaaagcctgtatcccggaatattgatttggtctggaccatgcatgatacaccgccaaatgacagaagtgcaatgcacagcactattgacagggtgcgtggaatgcatagaccgcagactatgccgataccgtttgtggtttcaaaaaaggcacctattatgtctgccgacagcggcatgatgcagtcagccttttgggcaatggtctgtgggatacgtgagactatagagaacaatacaatatatccacagagttttataagggtttcaaaccctttcattattccggcatcaacgatttgcatgttaagcttaaatccttgagccgggattttttgttttaagcttctgtttttgttaatcgaaagcatagctatcattcctatagcagatggcagataaagtgacacaagataaatgctgtagtggctgcatatgttaagttgctcggacagtgcataggtaatgataaagggaaggctgaaatggtttgccagtgcactcagtatttccctgtgatttttatctatgtatcctttggaacaaaaatctgctgtgagctttgctcctatcgggaatccaaatattatgcctattatgtatgtaaacagcatgatatgcttttggggaatgttttgcagcacatttgttgagataatcaggttagataaaatcgtaaatataaatagaagcggaaatatctggttgaaccatagcattatgcctgctttagcgcacgcacttacctgtgccggaaacaatatgtaataaatacaaaatagcagtataaaagcgataaacagtaattttttaagtttgtttttactcatgtgacagtatatgtggagagaaatatcaatatgattcgattagataaatttttatcagagatggggcttggcacacgctctgaggtaaaaaagcttataaagaccggacagatagccataaatggcacggtggccgcaaagcctgagacaaaggtagatactgatgccgacgaggtatcagttaacggcagaatagttaagtatcaaaggtatgagtattacctgtttaataagccctcaggctgtgtttctgcgaccagtgacaatgtgcatgatacagtcatggactatatcacggatgctgtgcatgatgatctgtttcctgtcggaaggcttgatatagacacggaggggcttttacttatcacaaatgatggagcactttcgcacgagctcttaagtccttcaaagcacgtggcaaagacttactacgcacgtattgatggtgaggtgacctgggatgatatcatcaggtttaaagagggtattgatataggcgaggaaagacctacaaagcctgcggagcttgttattaaaaaaagtggcagcgtatccgagattgagcttacaataacagaaggaaagttccatcaggtcaagcggatgtttgaggcgcttggaaagagggtaatctacttaaagagaatatccatgggaccgcttaagctgcctgatgaccttaaaacagggacttacagagctttgacacaggctgaaacggatatgcttatgcagataaaatccggcaaataaaataatttttaattatgaggtatgatatgagtaatggttttttaccaatttcaaaacaggatatgatagatgagggcattgagcagcttgattttgtgtatgtctgcggtgatgcatatgtggatcatccgtcctttggacatgcaataattgcaaggctgctgcaggcacatggctatacggtcggcatcatttcacagcccgactggaaggatgatgagtctatatccatactcggagtgccgcgccttggctttttggtttcggcaggtaatatggactccatggtaaaccattattcggtttcaaagaaaagaagagcaaaggattcatttacaccgggtggcgtgatgggaaagagacctgattatgcgaccgttgtgtactgtaacctgatacgccatacttataaaaaaatccctatcataataggcggcatcgaggcgagccttaggcgcatggcacattatgattactggtcaaataaggtcaagcgctcgattcttttagattccggtgcggatctcatctcatatggcatgggagaaagaagcatcatcgagatagcggatgcgcttgccagcggtatggatgtaaaggatatcacgtttatagatggtaccgtgttcaagacaaaggacagggatatcatatatgatgcgattgagcttcctgactatgatgttataaaagaggacaagagggagtttgcaaggagcttttacatacagtactgcaatactgatcctttctgcgcaaagaggctcatagagccatatgataactctacgcttgtggtgcagaatccaccgcagaagccgctgtcgcaggaggagatggatgaggtctatgcactcccttatatgagaacttatcatccaagctacgaggaggcaggcggagtgcctgctataagcgaggtgaagttttctcttatcagcaacagaggctgttttggaggctgtaatttctgtgcattgaccttccatcagggcaggataatccagacgagaagccatgagtcaatcatagaagaggcaaagcttatcacgcaggataaggactttaagggctatatccatgatgttggaggccctacagccaatttcaggcagccggcatgtaaaaagcagctcacaaggggagcgtgccctacaaagcagtgtctgtttcctaagccgtgcaataacctgattgttgaccacagcgactatatacagctgcttagagagcttcgtgcactgccaaaggtaaaaaaggtgtttatccgctcaggcatcaggtttgattatctgatgtatgataaagataagacgtttcttcgtgagctgtgtgagtatcatgtcagcggacagctcaaggtggctccggagcatatctccaatgctgttttgagcaggcttggaaagccgagtgtagaggtgtacaacagctttgtgaaggcatacaaggatatgaacaaaaagataggcaaggagcagtatcttgtgccgtatctcatgtcttcacacccgggctcaacgcttaaggaagcgatagagcttgcagagtatctgcgagatctgggatatatgccggagcaggtgcaggatttctatccgacaccgtctaccatctctacatgcatgtactatacaggacttgacccggcaacacttaagccggtgtatgtcacaactaacccacatgagaaggctatgcagagggcactcatacagtaccgcaatccaaagaactatgatctcgtgcatgaggcacttgtgaaggccggcagggaggacttaatcggatttgacaaaaagtgcctgataaagcctaggaaaatgcatactgatggcagctgggacaaaaaaacttctaagtctgataaaaattcaaacagcagctatggcagtggcaagaatgcaggtgtaaggaaaaacttgaaaaatgcaacagagcgaggaaaaaacggaagcggaagtaacacagcaggcacagcgcacaaaaagaaaacaatcagaaacgtccacaagaagaaaagatagatatacaagataagactatgaaagaatttaaagctggtaaaaacgaggcaggccagaggcttgacaaataccttaaaaagatacttccaaacgcatccatgggctttatttacaagatgctcaggaagaagaacataaaactgaatgataagaaagcgtcaggcacagaaattgtgtcagttgacgacaaaatcaagatttttctgtcagatgatacatttgctaagttttccgtcaatgaggacagtctgatgaaggatttcaaggcacttggtgcactaaagcctgacggacttggtgtggtatacgaggatgatgacatactggctgcaaacaagccagtcaatatgctgtcgcagaagtccaaggagactgatgtttctgcaaacgaaaggcttatcggatacctgataaaagagggaaagcttgattttgacacatataagagctttaagccatcggtgtgcaatcgcctggacagaaatacctcggggcttattctgatgggtaaatcgcttcatggactgcagtacctgtcacaggtgcttaaggacagaaccgcagaaaagtattatatggcgcttgttgcaggagaggttgatgagcctatgaccatagagggctttctgacaaaggatgaggctgtaaataaggtgcagataaccaaggagcccataagtgatgaatcactgccaataaagaccgcctacaggcctcttaagataattgagatgagtgcttcgtgccataaagcaactcttcttgaggtgcatctcattacaggaagaagccatcagatcagagcacatctttcatctatcggacacccaatcataggtgatatgaagtatggggataaaaggattaatgctttttacaaagaaaattatcatgtgaccagccagcttttgcatgcgcaccatgtgattttgcctgatggcagatatatagaggcggctttgcccgacatatggagcagagtgggactttaatttcgtcattatttactttatgtcgcatagcttacagtattaaggaagatagaaacgatatggcaacctggaattcaagaggcttaagaggctcgaccttagaggacatgataaacaagacaaatgaaaaatacagggagaacggcctggcgctcatacaaaagattcccactccgattacacctataaagatggagccggaaaccagacacattacactggcttatttcgagcagaagagtacggttgactatattggcgctgtacagggaatcccggtatgctttgatgcaaaagaatgtaataccgacacgtttccccttgccaatatacatgagcatcaggtagagtttatgagatgctttgaaaaacaggatggtgttgcatttatccttatatcgtacacacacaggaacgaatactattatctcacatttaaaaaactgacagaattctgggatagagctgcagaaggcggcagaaagagcttccgctatgaggagcttgagccggcatttttcctcccggaggtgcccggaatacttgtgccgtatctgaacgcacttcagcttgacttaaattgcagggcttgacagtattactatcgtatggtagcatattaccacgataacactttactacatgaaagcgagattttacacaatatggaaaatcaattattacacactccggacggagtaagagacatatataacggagaatgcaaaaaaaagctgtatttgcaggataagctgcaccgtacacttttaaaatacggatatcatgatatcatgacacctacgtttgagttttttaatatttttggaagcgatgtcggaacaaccccttcaaaggatttatacaagttttttgacaaggagggcaatacgcttgtccttcgtcctgattttacaccttctattgcaagaagtgcggctaagtactatatagaggacgatatgcctgtcaagctttgttatcttggcaatacttttatcaattcatcggattatcagggcaggctcaaggaaagcacgcagtgcggtgcagagctgataggtgatggctctatctctgcagatgccgagatactttcgatgacagttgagtcgatgcttgagagcggacttaagaatttccagatttcagtcggacattcgcagttcttttacggtcttacaaaggcagcagggctgtcaggggagcaggaggaagacctaagagagctcatagcaaataagaatttcttcggtgtggaggagtttgttgacagtctttcaatgaacgacaagctaaggaagctgtttggactattggacaatttcgatttacaggatgagcagcttatggaggcttcaaagcttgcgaagggctatgatgagatattatcatctattgatactctgcttaagcttagagattacttaaaggcatacggcatcgagaaatatatttcgtatgagcttggacttatcagtgactacacatattacacaggtattattttccagggctacacatatggtacaggagagcctattgtaaagggaggccgttatgacaagctgctttcacactttggaaaggacgctgctgcaatcggctttgcaattgttgtggatcagctcatggcagcattaagccgtcaggatattgatgtgcctgtcattgagaattcatcacttatagtatttgaggaggctgcataccatgcggcaatcaagcgctctatggagcttcgaagagatggagtaaatacacagatggtgcttaaggacaaaaataaaacgaaagaggactatgcttcatatgcggtagacaaccgtataaacagagtagagtttatagaggaataaaagatgagtgatgacagatatttaacctttgccctgggaaagggcagacttgcaaagaagactttgcagctttttgagcagataggcatcacctgtgaggagatgaaggatccggataccagaaagctgatttttgtaaatgaggagcttaagcttagatttttcctggcaaagggacctgatgtgcctacatacgtggagtatggcgctgccgatatcggtgtggtaggaaaggataccatcctcgaggagggcagaaatatatacgaggtgcttgatttaggttttggaaaatgccgcatgtgcatatgcggaccggagagcgcaagggagcttttacagcatcatgagcagataagagttgccaccaagtatcctcatatcgcaaaggactatttctacaataaaaagcatcagacggtagagattataaagctaaacggctcaatagagcttgctccgattgttggactttcagaggtgatttgtgatatagtagagaccggaactacacttaaggagaacggacttaccgtgcttgaggaggtctgtccgctgtctgcgagggttgtggtaaaccaggtcagcatgaagatggacaatgagcgtatcacaaagctcataagtgatttgaagactgttatcaaatagcgtataatttatatcaatacatgattttagacggaggctgtaatgagaattttaaaacttacaaaggattcacagaagaacatattggagagcctgcttaagagaagccctaacaactatacagagtatgagagcacggtaaatgagattataaacaatgtaaaggaaaaccgtgacaaggctgtttttgaatacacaaagaaatttgataaagcggatgtggatgcatcaaatatccgtgtcacagaggaagaaataaaggaagcatatgagctggttgatgagaagcttcttgccgttataaaaaaggctcttgtaaatatcagaaaatatcacgagaagcagctgcagaactcatggtttacaacagaggacggcatcattttaggacagaaggtcacacctatagcaaaggcaggagtatatgtgccgggcggcaaggctgtctatccttcatctgtactgatgaacgtgcttcccgcaaaggtagcaggcgttgaaaagatagttatgtgtacaccatgtggcgctgacggcaaggtatatccttccacacttgtagccgcaaacgaggccggagtagatgaaatctacaaggtaggcggtgcacaggctatcgctgcaatggcatttggtacagagagtgtgccaaaggtagacaagattgttggaccgggaaatatctttgttgcccttgccaaaaaggctgtgtttggatatgtcagcattgattcaatcgcaggacctagcgagattttggtgcttgcagatgagactgcaaatccacgctatgtggcagcggatttactctcacaggctgagcatgatgagatggcatcagctatcttgatcacaacaagtgaggagcttgcaaagaaagtatcaaaggaagtagataagtttgttgaggtcctctcaagaaaagaaatcatcgagaaatctcttgaaaactacggatatatacttgttgcagaggatatggatgaggcaattgatgcagtaaacgatatcgcttcagagcatatggagattgtcacaagagatcctttctcagtcatgacaaaaatcaaaaatgcaggagcaatctttatcggagagtactcatcagagcctttgggagactattttgcaggaccaaaccatgttctgcctacaaacggaacagcaaaattcttctcagccttatctgtagatgactttatcaaaaagtcaagcatcatctcatattcaagagaagcacttgagagaatacatacagatattgagcagtttgcagagtgtgagaagcttacggcacatgcaaattcaatcaaggttagatttgaggattagtcaaaggagtaagaaatggcagatagatgcgctaagcttagcagaaaaacaaaagagactgatatttcggtcggtttaaatatagacggaaccggaaaatcaaatatagacacaggcataggtttctttaaccatatgctggagggcttttcaaagcatggtttttttgacctcgatatgacatgcgacggtgacttaaatgtggactgtcatcatactatagaggactgcggcatagtgcttggtaatgctatagcacaggctgtcggagacaaaaagggcataaagagatttggaagctttattttaccgatggatgaggtgcttgtactatgtgccattgacttatcaggcagaccgtacctgcagtttgacggcgagtttacctgcgagagagtcggagatatggatacagagatggtgagagagtttttctatgccgtttcttactctgctgcgatgaacctgcatataaaggttttgacaccgggaaataatcatcatatgatagaagctatgtttaaggcatttgccaaggcacttgatgatgcctgcacctatgatagcagaataaaggacgtgatgtccacgaaaggaagtttgtaatttgactggttttaagaacatcgttgctacactgtatttaaaaaacggccaggccgtgaaatcagcgtctgatatgacagttatgggcgacgtctacaatctgtgtcagctctacaatgacagtggcatagacaagattattatttttgatctttcaactgatgatgatgagcatgagaaaaacatacatacgatagaaaatataaacagaaatatcgacataaaggtgtgcgcaggaggcaatatcaaccgcatagaggacgtgaaaaagctgctgtatgcaggctgtttacaggtcatcttcaatgccacaaaggattcaagccttgagcttgcaaatgtggcaagcgagaagtttggcaaggataaaatccttttgtcaatcagcaatgtagactatattttcaagcatcaggaggagatagaggatacctttcatgagcttttggtcttgaatatagatataatagatgcgcttgagaatctcacatccacaccgtatgtggtctatatgccgcagtttgacatggataaaataattgatgtcatgaagcgtgaaacactaagaggcattgcaggagagtttatcaatgatcctgaaaatgatatcatggcgataaagacaaagctttctgacggaggaatacttgttgacaattttactcccgacttaaaatggtctgatttaaagcttaattctgacggcatggtgcctgtcatagtgcaggattaccgcaatgagcaggtgctcatgcttgcctatatgaatgaggaggccttcaatgtcacgataaacagcggacgcatgacctactggagcagaagccgcaatgagctttggaccaaaggacttacatcaggacatttacagtacgtaaagtctttgacagcggactgtgattatgatactatccttgcgaaggtttcgcaggtgggagctgcatgccacacaggtaacaggacctgctttttcaataatatcgtgaaaaaggagtatgtggagaagaatccacttacagtgcttgaatcagtctatgcggtgatagttgaccgtatgaagaatccaaaggaggactcttacaccaatgccgtcatggaaaagggcatagatgagatattaaaaaagctcggacacgagtgcactgagattattctggcagccaaaaatccggacagtgatgatttgaagtttgagatatcagactttatgtaccattgtatgattcttatggctcaaaaaaatatcacatgggcagaaatcgcaggggagctggcacagcgatagccttaaaacacaataattatttagaggaaattatatgagaaaactagctttaagtgatgagatacttatgaaggtagacaaaccggctagatatatcgggaatgagttcaactcagtaatgaaagacacatcgcaggtaaatatacgttttgcgatgtgttttcctgatgtttatgagattggtatgtcacatctgggaatccagatattatatgatatgttcaaccgcatggatgacgtgtggtgcgagagagtttattctccgtggcctgatctgcatgaaatcatgaagcaggagaatataccgcttttcggacttgagtcacaggagcctataaaagactttgactttgtagccatgacgctgcagtacgagatgtgctacacaaatattttgcagatacttgacctagcacagataccgcttcgttcaagggacagagcggaaggctgccctattgtgattgcaggcggtccttgtacctacaatccggagccgattgcagacttctttgatatattttatatcggagagggcgagacacagtacggcaatctctttgagctttataagaaggcaaaggctgatggtctttcaagggaagagtttttacatgaggctgcaaagattgagggcctttatgtacctgctttgtatgaggtggagtacaatgaggatggaacaatctgctgtatgaagcctaagtatgatgatattcctgtaaagataaaaaaacaggtgcaggtagatttgacgaactcaacttacccggaggcaccggttgtgccttttatcaaggctacgcaggatagaatggtgcttgaaatacagcgtggatgtataagaggctgtcgtttctgtcaggccggtatgatttaccgcccaaaccgtgagaaaaaggttgaccacctaaaggacgttgcagcggcacttatcaaaaataccggacacgaggagatttctttaagctccttaagctcatccgactacaaggagcttgacgagctcatcacatttttgcttgatatctgtaaggaaaagaagataaatatctctctgccttcactcagaattgatgcgttttcactcgatatcatgcagaaggtgcaggatgtcaaaaaaagcagtctgacctttgcgcctgaggccggtacacagcgccttagaaatgtcattaataagggccttaccgtggatgatatcatgaacggctcaaaacaggcatttgagggcggctggaacaaggtgaagttttatttcatgctcggtctgcctacggagacagaggaagatatgaggggcattcctgagcttgcaaacgatgttgcggcattgtactatgataccgttccaaaggaaaagagagccggaaaatgccagattacgataagtacatcatttttcgtgccaaagccgtttacaccattccagtgggcgagaatgtatgagccatctgagtacctgggcagagccaaaatagtaaatgaccatgtaaaggagcagctcaacagaaagagcatcagatacaactggcatgaggcatatgtcactgtgatagagggcatacttgcaagaggcgacagaaggctttgcgatgcgatagtaaaggtatacgaaaagggcggatattatgatgcctggacagagtattttgactatgacagatggattgattcgataaaggaatgcggactggatccggatttctacacgatgagagaaagacctttagatgaaatattcccatgggattttatcgatataggtgtgacaaagcagtttatgataagagagtgggagacagcccataaggagacagtcactcctaactgccgcatgaggtgttctgcctgcggtgcaaagagctatggaggaggtgtctgctatgaaaattagagtgaagtttaaaaaatggggctgcatgaagtttataggacatctcgatatgatgagatacttccagaaggcagtcagaagggcagatattgatatccgctactcagagggctattctgctcaccagattatgtcgtttgcggcaccgcttggagtgggcatcacaagtgatggtgagtactttgacatagatgtaaatacaacagagtctacagaaaaaagcatacaagctttaaatgcccagatggtggacggagtagaggtgacaggctatgtgcttctgcctgatgatgcaaagaaggctatgtcgcttgttgcggctgcagactatgtgcttagcttcaaggatggctatgagagcccgtataccatagaagggtggaaggaagcgatagataagcacttttttgacgagccatcctttgttgtgatgaaaaagactaaaaagagtgagagagaggtagatataaagcctcttgtatacaagctaacagtcatggaaaataacaaaaagcctgagtttttcatgcaggtatcaacaggaagcattgacaatataaagcctgagtttgtgcttcaggccatatacgaaaagtgtggccttgattacaatccgcttgccatacaaatccacaggcaggaagtgtatgcaagaaaagacgatggaacactcatttgtctgcttgacatgggagaagaaatctcataatgaacagaattattctgactaaaacagtaaaaaataataagacatatacagtgtatgcactgatggatgaaaacggaaattataaggatttccagctccttccagataaggatacgataataaacaatatatacgcggcaagggtaaataagatactgccgggcataaatgcggcatttgtgaccattgcgcagaataaaagctgttatctgtcgctaaatgatgcaaaaaatcctgtatacacaaacaaaaaatcaaaaaaagcaggtttgtgtgagggcgatgagatacttgtgcaggtcataaaggatgcgctaaagacaaaggatccggtggtcacaacaaagctttctatattcggaagcaatgtgattctcaccaattttgatacacagataggtgtttcatcaaagctggataaggaaagggcggctcttttacgtaaggctgtgcttttaagttgtgcagaccacgaaaaagagggctatggcatcatagtcagaaccaatgccaaaaatgtggaggataaagctgtttcgcaagatgcgtattctgtagcacagaaatacaatcagataataaaaaaggcaccgcatcaggcgctctattcatgcgtatatcatgggatgagcgattatctgcttttaatgaagacaattgattttgccacggtggagtggataaagactgactgcgatgacatatatgacagtcttcttacagagtacggcatatatgaccatgctcctgaaaagataatgagatatgacgattcagctatcagcctgtcaacgctctatggcataagagggctgattgataatctgacctcgcgcagggtatggctggactgtggtggcaacatcataatagaacagcttgagacacttacctttatagatgtaaacagtgcaaagaatatatcgtcggggagcaatagcatattaaataccaatatggaggccgcaaaggagatagccaggcagcttaggctcagaaatatctccggcatgataataattgattttatcaatatgaagtctgaggcatcaaaggatacgcttattgaagagctcaaacggtatataaaggacgataatacagtctgtacctttgtggatataacgaagcttggactggtggagctgacaagaaaaaaggtccacaaatctcttaaacaaattttagaaaaaacacttgacgaatagatggctctatgctaatatactggagtatgccgcacagcgaggtataagtttgcgactttcgcaacaccgtaactggcgagtaatgataaataggaggtgccatatgtacgcaattatagcaacaggtggtaagcagtacaaagtatctgaaggcgatatcattaccattgaaaagcttggcgttgaagctggtgagaaggttacttttgatcaggttttagttgtaggcggagatgatctcaaggttggagatccaacagttgcaggtgcaacagttgaggcttctgtagttaaagaaggcagagctaaaaaggttatcgtttacaagtacaagagaaaaaccggatatcacaaaaagaacggacacagacaggctttcacacaggttaagattgaaaaaattaacggataatgatagctataaccgtttatcagaattcaaaaggacataagatgggctttaagtcaaagggacatgcaggttttgcagattccggttatgatataatctgtgccggggtttcagcgctggtgatcaacttcatcaattccgctgaagagctgtgtcatgctgagtacagccttgatacagacgaagagacaggtatgattgactacagacttgacaagccggcgacaggtgatgttgcactgcttatggattccatgattctgggactaaaaggaatacaaagagactatgggaatgagtacatcattctagacttcaaggaggtgtaagacatgttgaatatgaaccttcagttttttgctcataaaaagggagttggttctacaaagaacggacgtgactctgagtctaagagattaggcgctaagagagcagacggacaattcgtaaaagctggtaatattctttacagacagcgtggtacaaagattcaccctggtacaaacgttggtatcggtggagatgatacattatatgctaaggttgatggcgtattaagatttgagagagttggaagagataagaaacaggcttccgtatatccagtagtgaacgaataagatttaaaccccgacttttattagccggggtttttatgttgtaaattagcagcatgtagtaatctgattaatcataaatgaggggcaaaataccttttgacccttatatcattttgttattactgtgtcttatatagatatagtataacagatatagcatagtaatgatttgttataaagtatactgagtgttttatgcagacattcagcatgaggtggaaaattatgtttgcagatcgtgcaaaaattatcataaaatcaggaaaaggcggagatggtcatgtatcattccgacgtgaaaaatacgtgccgaacggtggtccggacggcggtgacggaggaaagggcggagacgttatatttctcgtggataagggaatcaacaccctgacagattatcgtcacagaagaaagtttgcagcagagcccggacaggagggcggcaaaaagaactgccacggaaagaatggtgaggatcttatacttaaggtgccggagggtacactcataaaggatgcagcaagcggaaaagtcatagcagatatgtccggtgacaatacaaggcaggtgatcctgcgcggaggaaaaggcggtcagggcaaccagcactatgccacatccaccatgcaggctcctaaatatgcacagccgggacaggatgcaatagaaatcgaggtacagcttgagctaaaggtaatagcggatgtagggcttgtaggctttccaaacgtaggaaaatcaacacttctgtcacgagttaccaatgcacagccaaagattgccaactatcatttcaccacattacagccaaatcttggtgtggttgatatggatgagggctttggcttcgtaatcgctgatatcccgggacttatcgagggagcatcagagggcatcggactcggtcatgagtttttgcgtcatatagagcgtactaaggtgatgatacacatggttgatgctgccggtactgaaggccgtgatccggttgctgacatcaaagcgataaacaaggagcttgaagcatacaatccacagcttctcaaaaagccacaggtcattgccgccaacaaaatagatgccatagcaggagacgaaaatgaggtaatttcggccttaagagccgaattcgagccacagggcataaaggtattcccgatatccgcagtaagcggtaagggccttaaggagcttttgtacgaggtgaagaacctgcttgcaaattgtcctaaagaggttactgtatatgagcctgagattgatcctgcactttcattctttaaggatgagccgtatgcggttgaggtggcagccgatggtgcatatgagatatcaggtccaaagattgagaaaatgctcggatacacaaatatggactcagagaagggctttgcctttttccagagattcttgcgtgagcagggtatcatcaaggagcttgaaaatatgggcatcgaggatggagatactgtccgcatgtatgatttcgagtttgattattacaagtaaggagaagagtatatatgaatttatcaagtaaacagcgtgcatatttaagcagccttgcaagcacaattaaccctattttcaatattggaaaggcatcgcttactccggaaatcatcgaggctcttgatgcagcacttgaaaagagggagctgatcaaggttgcagttcttaaaaactgcatcgatgatccaagagagattgcaagtgtaatcggtgagagaacacactctgcagtggttaaggtaataggcaaaaaaatgattttttaccgtcctgcgaagaaaaatccaaagattaagcttccggaataagccatgaaaacagggatttttggtggggcatttgacccgatacacaaaggtcatatatacatggcacaaaaggcgatggaagagtattctcttgacaggattctgcttgttccgtcaggtcactcgccgaacaagactgagaatgcaatgacagcatttagccaccggtacaatatgtgtaagctggcatcagaagcagtgcccggtattgaggtgtctgatattgagataaaggatgagtccaccagctatacgtatgtgacactccaaaagctaaaggcgctttatccggaggatgagctgtatttcatcatgggtggagattctctggactattttgagtcatggatgaagcctgagataatagcccaaacagcaataatccttgttatggtgagggaaaattttccaaagcagcagatggaagaaaagattgcacatatcaaaaaacagttttgggcagatataagacttttaaagtgtgacaggatggatgtgtcgtctactcaggtcaggagactgctacgtgccaagtcgcaggcagacgggtataggagtcctaaaggagcggaaatgtttctggatgctgcagttatgtcatatatacaggctaataatttatacaggtgatagagtatggaagtaaaagaaataaagaaaaagctaaagaagagccttgataaacaaaggtatcagcatacgctcggagtgatgtatactgccggctgtcttgccatggcaaacggctatccgatagaaaaggcaatgcttgcaggcctgcttcatgactgtgccaagtgtctttcgactgaaaagaaaatcggactctgtgtaaagaaaaatatagacataacagaggtagagatatcaaacccgggtctgttacatgcaaaggcaggcatggtgctggctgaggaagagtatggcattaaggatgcgcagatactgcacgccataagagtgcatactacaggagaagcagacatggggcttcttgacaaaatactctttgtggcagattatattgagccaaacagatgtgaagcaccgaggcttgaagatataagaaagcttgctttttcagaccttgataggactgttgcagagatattgtatgatacaatcaattttcttaatacaaagagtggggcaatagatccgactacccagattacttacaattattatgctaaatacagagacaacagggaggaataactgctatgcagacaattgatttagttaaaaagatagtggaagcacttgaagacaaaaaggcggaggatatcacagttctcgacataggagaggtttcttctatagcagactactttatcattgcaaacggaaacaatgcaaatcagctcacagccatggaggatgctgtggatgaggctatgtatacaaacggagtgcatcagaagcaggtagagggaacaggcaactctacatggattctcatggactatcaggatattatcgtgcatctgttctctaaagaagacagacagttctatgatctcgacagaatatggagagatggaaaagtggtggatgtacattcactgtagtatttattctatgattaaggaattataaatcgaaaccggtaatttaaaatatcgcacccatatgctgagctgtttagcttagcatatgggtgcgatatttttacaataaataattagaagaaacgaaatactccaaacactttgccaagtatttcacagtccggaactatgatcggatccattgtgtcgttctccggctggaggcgaatgtgaccattctctttatagtaggtctttacggtagcggaatcatctataagtgctacaaccatgtctccgtttgaagcatcactctgctgctcgacgaggatattatcaccgtcaaagataccggcattgatcatgctctcgcccctgactttaagcataaatgactgcttatttggcatatattcagcaggaacgggaaaataggtttcgatattttccactgcgagtatcggctcacctgcggctacacgaccgaccagagggacattaaccatctcgcggcgctgtaaaccaaagctgtcatctataatttctatagccctgtttttggcaggatctcttcttatgtagccctttcgctcaagtgtctcaagatgggcatggacgctggatgtggactttaaatgtacaccctcgcagatatcacgtactgatggcggatagcccctgtttaaaatctcactcttgataaactccagtatctctttttgcttgtctgaaatcttttctaatgccatagttaaatcctccgtctgaatatttaaataatataatgatatgagggtcaaaaggtattttgcctcttcgttcataattataataaaaaaattgtattttaaaaaattatatcataaaactaaaataaacgcaaacatatattccgaaattttgttcgcttttctattgacaaacgattgttcgggatgtattatgtaatcacaataacaacaaacacatgttcggaaatacaagaggtggttttatgagagaaaatactttatcaggtagaagaaaaatgtttggatggactgctgttgcatttatagcagctgtcattatattgtgtggcactattcatatttttgccagttctggtgacagcatgccttataacaagtattataccagcgtcagggttgaggagggcgacactgtctggagcattgccgatagatatattgccgacagtcaggtgagcaaaagagattatgtagatgaaatttgcaggctcaatagtcttacagatggcaatgtccgcagtggcgattatatagttgtttcatattattctcaggatataaagtaacgttttcttgctaaaatttcctgtttcttatataatataggttaattgcagcggattttggttatagtatctatagcttatccgtttttgaaacaggagattggatatttatgttaaaactattttttgttatatttgcaaattttcatagagcaccgtatattgttcccaaaatgagatacatggctgatcatccgcagaaatattcagaagcggagagatatgatatgatgcggcactgtatagatttaatgaataaatcgggaaaaattacaacagaagcatatggtcttgagaatcttcctgaaacaggcggttatatcatgtatcccaaccatcagggaaagtatgatttactggggattattactacacatggcaaggtactgtcgtttgttatggataagcagaagtcgcatacaatgcttgtcagggaatttgttgatctggttcaggcaaagcgtttagagaaagataatccaaggcaggggcttactataatcaatgaggtagctaaggatgtgaaaaacggcaagagatatgtcttgtttccggagggtggctataagttcaataataagaataaagtgcaggattttaaagcaggaagctttaagatcgcattgaaatcacatgttcctattattccgatagctcttatagattcatataaggtgttcaacagctttcatttcggccctgttacaacgcaggttcactatttaaagcctattgagtatgatgagtacaaggacatgaagacgagggatatagctacactggtcaaggagcgtatagaggagaaaatcaaagaaatacttggttagagtcaactttgattattatatagtattattatgaaagacaaagcttattacgaagacgtaaatataaaaaatgaattaaagctcagagatatgatacagaagcttccgaagttctgtatggatttttttatcggaatagatgcggataagtcctcaagaaccaagatagcgtatgcatatgatctacagacatttttcgagtacatgaagagtgccaatccatcgcttaagaaatatgatataagggattaccctatatctctgttagatcagatcagtccttcagatattgaggaatatctgttttatctaaagtattatgagaaggatggcgtcgtacacaccaatgacgagagaggcattaagcgaaagcttgcatcactgcgcactttttataatttttatttcaggaaagagtttatagataccaatcctgcgagcaaggtaacccttcccaaaatacatgagaagaatatcattcgtcttgatactgatgaggtcgcacagcttctcgatgaggttgagtcaggagacagtctgtccaagaaccagcagcgtttccacgagaaaacaaaggttcgtgaccttgcacttatgacactgcttcttggaacaggtatccgtgtatctgagtgcgtggggctggatatggatgatgtagatttcaaaaacaatggaatcaaggtgcaccgaaagggtggtgctgatgtgattgtttattttggtgatgaggtacgtgatgcacttctttcgtactgggaggagagaagcataattacacctgccgaggggcatgctaatgcgctttttctctctttacagaggaagcgtatatctgtacgctctgttgagaatctggtaaaaaagtattcgagactcgtaacaaccgttaagaatattactcctcataagcttcgcagtacatatggcaccacactttatcaggaaacaggtgatatctatcttgtggcggatgttctagggcacaaggatgtaaataccacacgtaagcattatgcagcccaggaggacagcaggcgtcgtgcggcagccagggtagtacatctgagggaggattgattatatgtctgataatataatcacaattacagattttatggaccccaatctggatgtgtatgccagattgacggagaatcagcttttaaacagagccaatccaaaagaggggatgtttatagctgaaagtccaaaggtgatagagagggcacttgatgcgggatgtgaaccggtttctcttctgatggagacaaagcatgtaaatggcgaggcaagaggaattatcgaaagatgtcagaatatacctgtatatactgcgtcatttgatttgctcacaaagctgactggctttgctttgaccagaggcacactctgtgctatgtacaggccgaagccaaggtctgtcgaagaggtgtgcagggatgcaagaagagttgcggtgcttgaggatgtggtaaatccaaccaatgtcggagctatattcaggtcagcggcagcactgcatatggatgcggtgctgctcactcctgcctgtagcaaccctttgtacaggcgtgcaatcagggttagtatgggaactgtgtttcaggtgccatgggcatattttcctaagtacaatgtcggcagtgacaacactttttcagatgcttcattgcatgataagtgtgatagtcgtgaccaaaattgcagcgaccgaaatagcagtgtttataaatacaatattgatgtgcttcataagcttggatttaagacctgtgctatggcactgactgatgattccgtgagtatagatgaccctgtgcttcactcagaggaaaggcttgcaatagtgctcggcactgagggagatggccttcatgagcagactatagactcctgtgattacactgtaaagataccaatgtcacatggcgtcgattctctaaatgtggctgctgccagtgcagtggcattctgggagctggctaaataggctgatgagagtgctttatattgtaaattttgacattttcgtcagcactgtttctaacttcagttccttcgcatacgcatccgagtggtaaatccgcatagtttgtgctatcgcagaaggcactttggcggctgcagtcagttttatcatctgatatgccgcagatgttggatttattggtatgatacggtttaaagttttgcctgctgtagatattctggtcggtattatgtgtattggaattatatatccctgtattattcatgaatagtcctcctgattgatgcttgtttatttgtgttttgtttatttgatgttttaatttaatttttatttgcagctatcctgaatatgctgaatagttactgttatttttcatcctaagtatgagtttagcatgtgctgtgagtgattattttatgtatcttatttttaattgcgatttcggttagagtcttttttaattaaaattgtggcaatcataaatataatttacacctttgtacataataatgctgacaggaggtgtctattaaatgattctaacagaaaaagaaacaaacgctattgaagatttaaaaacacaggaacaggcatgcatagagaagtataccaaatacagcaatcaggcaaaggatcaggtgcttaaggagctttttgaagaaatagcaagggatgagcaaaagcattttgactctttggatcaggtgattaagggaaaggttccgtcagttgactgcaatgattctaaggggaagaattataaccctgctgcaacatacgattcgcttggcaattctgaggacaagaaagctgactgttatctggctacagactgtataggaacagaaaagctagtatccggcgagtacaattccgatgtatttgtatttggaaattcggatatcagaaagttattggcagatatacagatagaagagcagaatcacgctgagatgctatggaagtacaaaactgcgaatggtatggcatagataaaatataaaaccatagaatttagtacaaagtgtaaaacaggactgcctgaatatcgacagtcctgttttataggtttagttgccggttggaataaaaggtctgattgcacctgcaagctgagaaaccggcatgctctggagccatacacggccaggtccggtgacaacggtgttgaataatccttcaccgccgaataccacatttttgatacccggaacagtctgaatttcgagctgacagcttcctgtcatagcggctaagtatccggtatcaatcaccagctgctgaccgggtgcaagctcgtattcctttatgtggccgtcaaactctaaaaataccaatccgtttcctgacagacgctgcatgataaagccctcaccgccgaagaaacctgctcctattcttttttgtaaaaatacggacagctcaactcctgaggttgaagcaagaaatgctgatttctgggcaattatctcctgtcccggtgcaatctggaagggtctgatgcatcctggaaagcatgatgcaaatgctatcattcccggaccacccatagatgtgtagcgattttggaacatactctcacctgaaaatgcacggccaaacattttgccgatgcctccatttgatgtagtttccatcttcatgtttggagtcatccatgacatggcacctttttcggtaatcatagtctcatttgcctcaaggttgcagatcacaaccggtaatggctctccctcaatattgtagttcataaatatcctcctttagttaaaaaatggtttgtagaaattttatatttataattctaacacagtaatacgtcacttgacaatataattcataaatgtacacgaaagcttataaatgaatacaaattgcctaatgaaatacactttagggattgcggtgttcatatgatcttgactgaaactatgtgggaaaagtcacagactgacttgtttattttataaatatggtttagaataatatggttattgttggataaaaatggtagtaaaactatatgtcatataaattgtaacaaaataattatatctaatttataacatgtaaataacatatttaaggagacaacataataatgagatttgtaatacagcgtgtaaaccatgcaaagtgcactatagatggaaatataaccggcagcatagaaaagggactgtgcgttttgataggcatagcagagacagacactaaagagattgctgataaaatgatcaaaaagcttataaacatgagaatttttgccgacgagaatgacaagacaaatctttcgataaatgatgtagacggaaagcttttgcttatatcgcagtttacgctttatgcaaattgtaagaagggcaatcgtccttcatttgtggaggcaggaagtcctgatatggcaaacgagctttatgaatactgcatcagcgagtgtgataaggcagttccaggagtacaaagaggggtgtttggagccgatatgaagatagagcttgagaatgacggaccatttacgattgtactggattcggacaagctgtaaaagatataagtatgaaaggcatttttatggaacaatcatttctgttcacagttttttggaaagatgaaatgtacataggcgatatctctgaaatgatggataatctcggatgtatcactgatggaaataatatagtgcctatcatagctgccatgggatatgctgtgcaaaacgataacagcacaaaggatattaatgagataatccatgaggctgattcaaggatgtatgagaaaaaacgctctatgaagcatcggaaggcttagtgcatttcacccaatcatcgatattgccgttttgaatagcagaaaacagtcttttcttgacacccggattttccatattgagctgtctgacaagctgctttacatattcgcgccgtgtgtggccgtcgtaagggcatggattcttgcacaccggcaaattgtatttattcttaaagcccttcacatctgactcgccgacatacataagcggacggatgatggcaagcccactgccgtccagctgtgtaacaggcgcgaacgaataaaactgtccctcatatagtagggaaagaaacatagtctctataatatcatccatatggtgtgcgtatgctattttattgcagccgacagacagcgcaaaatcattcaaagctccctttctaagctttgcacaccatgagcagggactagcctgattcttagatttctcaagagatattcttccaatatcagttttcaccacataaaactcaacagagagctcatcgcacagcgccttcaccggctccaaatcaaaatcctcatagcccaggtcaaccgcaatcgctacaagctcaaaaggcacaggataaaagcttctgatgccggaaagagcataaagcagagtgagagaatcctttccgcctgagacaccgatggcgattttgtcattttcagttatcatattgtagtcgtcaagggcctgacggaccttgctgtataatttttgtaatttcatggtaggtattatactataaatctgtgaaaaaacaaagtttcgaacacaaattaagattataatgatacaaattctgaaaagtgtaatattataggaataagatatcaaatttttgtggagaagatattggagaggaagttgatgaatagaagtccggggggcagattccctcggatttggcgtaatataaaaaaattgggggacatgagaactatagaataactatttgacatggtggacagaaaaaattattataaacataagaatagtagatttgaaagtttaagggatgattaggctatggcaacaataaaagatgtggcaaaggcagcgggagttggaacgggaacagtttctcgagccttaagtggaaaaggatatgttgattctgaaaagaaaaagcagataattaaaattgcagagcaattagagtatgatccttcagcgttattaaaaagaaaaaacaataaaaaagttaaaagtggtttaataggagtagttcttccgaatagttcacaaccttttttcggaagttttttgtggcatgtagagcaagccttggaaatgcatgagtatcgaacagtaattattaatgttggcggctcgtccaaaaaaatatctgatgcgattgacttggtagataaacatatgttggatggattgatcataaatgctgatgtagataaaagtgatatagagcgattacgattgattccagcagtaagctttgagtgtgaaatgggagaaggtattccgcttgtagcatctgatcatataaaaggtggcgaacttgcagcaaaactgctctttcgatgtggatgtaagaatgtagctattttaagtataaaggcaactgcacctgtatatgcaaggcgtcgtattacagaatgtcagagattattgaaaaaaaaaggtgtaaaagtaacgattgtagagcatgagggtggatcagaagagtttcatgtcatggaagaaaagataaatgagtatttgaatactcactcagaagttgatggcatttttacggaggatgtggaggcatatttttgcttggtgcaggcgaaaaaacgaggaatttccattccaagagatcttaagattgttggatatgatgggaatgaaataacacgtttagttagcccacaggtaactactattgcacaaaatacaaaaaaattagcagaaacatgtgtagatgtactgaataaaagaatcagcggattggatacagaagacagatattttgttcctgttaaaatccgaatgggtggaacgacataatatcgttccataaaatatttgtatataatttataatgcagaacgttaaaacaaggcgttctgctatttttttgtgcagaattcataaaagacttgaatattggcttattataaagtagcatttgaacaagaaataagaaaacaaaagttgtgatgaaaaggagaacataatgaatcaaatttatacttccgatttgctttcttttcaaaaaagattagcacctacggtggacagtgatgtagtgattgacagacccaagacagaaattttgccggagccatatgtgattacccatgagagaaaaattcgatttaaactatattatccgaatgcaagaaaagtagaaatgtgggattatttaaaagaatataagcttgaaaaaaatggagattattggtgcggagaatttgatatgggggaaggattcattgcaatatttctcaaagttgatggcacaagtattctatcagagttttttccgataggatatggaggaaacaaagcgataaactatatagacgttcctgaacaggatcatccaattgagctattaggagaaaatcatggaagtgttcttagtgatttttttgaaagtaaaataaccggacaactagagagaattatgatttatcttccaccagaatatatgcaaaatacagagaagaaatatccggttctgtatttgcagcatggacatggcgaaaacgaaacatgctgggtaagccaggggaaaatgaattttatatatgataatctggtacatcaaagaaaagcagttcctgctattgttgtgatggcaaatggaatgatatatgaggagagtggagacaaaagagaattaaagtatcgtgatatgtcagcatttgtaaaggaggaattaattccttatgtagaaaataaataccgaacctacggagataaagaacacagggcaatggctggattgtctatgggaagtttacagacttctattacggcatttgaacattctgaactgttttcatatgtgggagtattcagtggatttgtacaagatatccttacacagaatcagagtcatttgactgaaaaaaataaagaaagctttcgagaaaacaataagttattttttagagggattggagctgaagacagatttattgatttctttaagtcagacgatgaatttcttgaaaagtctaaaataaaatgtgagagaaaaatatataaaggtgatcatgaatggaaggtatggagacgctgcttatatgattttgctcaactgatttttagagaagataattagtatagttattgataagtgaggaaaagatgacaggagtgcaaatagtaggaatagcagtgatcagtttagtggttatattcttagtggcagaatactttatggccaattttatggcaacatatattttgacaccgccttctaaattatgtccaacgccggaacagataaaggagcggaaaacatgtgaaatatcagcggaacgtgctgtttatgcagatgcagattttgatgcttatgaagagtgggaaacagaaagatttttttgtgaaaataacggaatacatataccggcggtatttcatccactggaacacgcaagaggatgtgcgattcttgcacatggatttggacagaatcgttacgctatggttccttatgcggaactgtttcgtaagttgggattttcaacagtattgtttgatgagagaagattcggtgaaagtaaggcgccgtacgggacatttggtataaaagaggcaacggatgtagcagcactggtagagtgggtgaaacaacgttgcggacaagataccaagattgtactgctcggtgtttccatgggagcggtcagcgttatgaatgcattaaaatatactgatgatgtagattatgttgtggaagactgtggttttatccgagtgtctcaaggattgccatttgtttatcgaagtatggtgcatataccgaatccgtttttaatgccggttgtaaagaaacgtgcaaagaaatatggatttgatatgctggacaataatccaattgatgcagtgaaaaattcaaaggttcctatttgcgtagtgcatggagatatggatagagccgtttccgtagaatgtgcaaaggaattgggaactgtaatgaagaatccaaaatctcgtgttgaaatctatgaaggaagagatcatgcttacagtatatgtgataaagagcgatatactcggatgttaagtgattttttggatgagatgtttgtatttccggtagaacaggaggagaaacatggcaaataaaaatgaaattgtaaaacttacagatggcgtttaccaaataaagtattattggcttggaattgcaaatgtatatgcatatttgatagttggaagtgaaagggcattattgattgacacctgttattcaattaccggaattaaaaaatatgttgagcagataacgacactccctgttgatgttgtaaatacacacggacattttgatcatatagggggaaatgcggaatttgagacaatttatctttcaaaggcagacagagaggttgccggagaacattcagactataatgctttgcgtaaaatgatagataattatgaagaaaagaatgtattagtgagatatctttttaagttaaaaaaatataagaagcaggtggaagatagtcttcatataaagtcagtagaatataaggatttgccattatgtggattttttaatctgggagaaagaaaagtatcctttatagaaacgccgggacatactccgggaagtatttgtctgtttgatgaaaaaagcaaatatttctttgtgggagatatggcttgcgaagaaggagttttgctaggttttgactattcgaccagtgtagctgaatatcgggaatctattttgaaaatgcagcaattttataaggaatatgaaggaaaagcgattattccctcgcatcatcagatgccggcaaaatcagatatttttgagcgttatatctcactgtgtaatgatattctgtcaggaaaactgacaggtaaatatgaagatcagggactttgcgatggtaaggttgtaaaaggatacaaattacagatggtatatagaaagataaaataagaacaggatgggataagaaatgaagttatttacaaaatcaatggagccaaataccactctcggtgtggctgaaagagtggcatatatgtcaggaaatataggaattgcattaattaatacaattgttgcgacatttttgatgtttttttatacggatgtaatgatgctgaatgccggaattattggtacaatcctgatggtttcaagattatttgatggtgtaacagatattattatgggaatgattgtagacaggacacattcaaaatacggaaaggcaagagtatgggtaatcagaacatgtattccgtatgcaatcagcgggttactgctcgtttgcgtaccgggtggtatgacagagcttgttcagtatatttatgtatttattacttacaatatttgtaattccgtttttctgacagcgctctatgtgccatataatgcgatgacatgtaatattacttccaatccttatgaaagaggagttttaggaatttttgtattgtttggtgctacatttggaacactcgctgtgcagtcaacagtggatgctgcaacgaaagcgttgggcggagatcagcgagcatggcagattgtagttgggatttatgcgatttgtgggttaatcctgcaccttatttgtttctttggaacaaaagagcgctgtggaagtacatctgaaaaagtgaaaattcatgcgaaagaagaaatgcgttctttatttacaaataaatattggattcttgcgattatgacaatcttatttgtaatgttttttacagcatttaccgggggagcagggctctactttgcaaaaggtgtcttaggagacactgcttattatgcacaatttgcaaactttatgtctgttacacaaatgatttctctttttattgcatttgttccgatgaaaaaatgggggaagagaaatacattgatgattggattgacgattatggcaatcggaactggtattcagtgtatttggggaaataatcttacaatgcttatagtttgtagtgtgctgaaaggactaggcggaggatttgcagcaggagttggatacggacttgttgcagatacgattgattatggagagtggaagacaggaacaaaagcagaaggagtcggtatggcagcgatgacatttgttacaaaagtttctgccggatttgccggagcaattatcggatggattaatgaaatgggggggtatgaggcagcggcagcagtacagaatgccaaggccgtttttggattaaaagttagttttagttatctgccatttatattctgtgcgttgggatttgttttgatgattttttatgatttagacaaaatcttcccacagattcaggctgatttagagaaacgaagagaaaacaagagcaaataagaaagtgaagaggaaagagatgaagaaaaaagaaatcattgataaaattttgcaatatcatccaaacatagagcattatcacggatgtgatgaatataaatcgggatttgaagaggaaaagtgtaccggaattgtatccgcattggttcctacaatggaagtgttgaaaaaagctgtagaacttggctgcaatcttttggttgttcacgaaccaatctattatcagacaccggatttcccagactggaagggtgactttgaaaatagtgtacaaaaagaaaaggaagcttatattcgggaacatcggcttacggtttggagagaccatgatcatatgcatacgcatcagccggattctatttttgcaggcgtaataaagtatctgggatgggagtcatattttaacacagaaattagtggaatgatgccgtttttttatgtttttgatattccggaatgtaccgtgtctgaacttggagaagaattaaaagaaaaaataggcatgaatggagtacgtattgttggaaatccggaagataagatgaaaagagtagcgattgtggcacatttgtatcctaatagtgccatggtagacgaaataaaagaagatggatattaccatagttatgacatggaaattatgaaatatatggaaacagagaatattgatgctatcattccgggagaaatcattgaatggacaattctttcttatatcagggacgctgcgtatatgggaaaacacaaagcatgtttcaatatcgggcattttaacatggaagaattaggaatgaagtatgcggcagattggatcggtgaattactgaacaatgagattccggtaaattatataccgacagaagatggttggacatttctatagaagaggtgattagaattacactcatcgtattccaaaatataatgatgcagaacgtctgcatgtgttcagggaaagtgccttgaaaggtatgattgctgctggaacttatacaaaggaaagagttgagtgtattcataaccttcaggttaaggaagatgatgcaaatccaaaatacagtaaagagattgtaaagaaatatacaaaatgtgtagtcgtcgtaattatgcattttcagaagaacggaaataaagaatttctcaagatgtgaaaagagatttatattatttataaatgggaaggagtgtatgttctgatttcaatgtaaagcgataaggggaaaccttatcgctttattaaaagaagaatgtgggattgataatcatttaattttacataattagatgtcagtagaaagttttttaatttttcttatagcaatacgataagaaatgtaaaaaaataacaatactccaaggaaataaacagttagaaatattaaggagacaataattctttgattaatctgttcaagatagaaaacagtatcaatttggaaactctcaacaaaaacgataatagtatttaaactagaatagcatagtgcaaatagccaacaccagagtggaaaatgttgggttccattaaaaagaactccttttattgacatccaaatgattaacacatcaggcgctaatggaataacccaaccgtttaagcttgttttaaaaaaataatctagtagataagtaagttcatttgctataattataccccaaaaaagtttaacataaattgtgtgccgaatatttgtgatcctttcatcacagtgaatggtggttttcataagttgtcctcctcccaaaataaatcgtttaatgttttgttaagtactttacatatccgaatacaaagctgaagactgggattaaactttccgccttctagtaagttgatagtagggcgtgtaacattaactttggcagccagttcttcttgagaaagattcatctcaacgcgtgctaatttaagacgcatatttttcatttatacaacctcctcctttctatatgcattatatgatatatcgaactaaatgtaaagtatatattacaaaaaataataaatatataacgttatgtgaaaaagattattatgttttggtaaatagtaaactgagaatcccatttgtaacccaagactccccatttgtaaatgaaagtcctgttttgtaaccgagattcctggtttgtaaatgaaagtcccagtttgtaaggcgataataattgacgaatatgcccgttgcccatcgttcgataatgtgttatacttgtgccatacaatgtagacataaggagaagcgttgaaatgaacaaaggcaaaattcgtacaaggagactcacaatccgcgcgaagatcctgattccgtcaatcataatcgttgtactcgtctgtggtttgatgggatacaattcctacacgcgttttgagaaaagcatggtgaggatgggcgttgaggaagcagacatggcggcaacgatcgttgcggattcgctggatgccaatctagtatacaaagtgacggtaggatcggaaggtacgcaggtctatcagaatctgcaaggagatctcagaaaaaagcaaaaagcatgcggaattgcttttttatacacattgtatacggacggaaagaaagtgtattatggtgtggattcggacgaggatgcggcaaaagtcggtgatgaatttgcggattcatacgcggaactggagccggtgttcggtggaaaggaatacattcaggattacatcgaccatacagaagacggagatctgattacggtatacaagcctattgaggacaatgcaggcaaggttgttgcaataattggatgcgattatgatgcgtcatcgattacagcagaattacagaaggcagttgtccagacgttacagatcggaggcatctgtctgattctggcaatcctgattctgacgattatcgttagcaggattacaaagggactgatgcaggtaaatgcgaagatttatgatctggtacataatgagggtgacctgacacagaaactggatgtcagaagcggggatgagctggaactgattgcgggcaatgtgaatgagttgttagcgtatatccgcaagattatgatcggaatttcgtccggatccatgcggcttatgtcttcttcccgcaaaatggtggatcatctgagctctgcggatgaaagcattaccgatgtgtcggcaacgatgcaggagatgagtgcggcgatggaggaaacgacttcttcactcaatcagatcacggaggcaattgacgaaatctattcatcggtagagcgtattgcaggcaatgcggatgccggaaaagtctcttctcaggagatggagagccgtgcttccggggcgaatgatgcagcagcggagggagagaagaaagcaaacattgagaccgagaagatggcggattctttaaatgagaagattgcaaagtccaaatcggtggaacagatcgagattctaacttccaacattatcgagattacggaacagaccaatcttcttgcgctgaatgcaagtattgaagcggcacgcgcaggggaagcaggacgcggctttgcggtggttgcggatgagatcggaaagctggcaggtaattctgcggatgccgcagcaaaaatccgccaggtgagtgcagaggtcattcaggcagtggatgaactggcagagggatcgcagcagatgatcgaatttgtccgcaattccacagaggaaggcttcggaggtcttgttgcaacgagtgaaaattatgcgaccgatgcgaatgcaatgcgtgcaatgatggagcagttcgcgcagactgcggaagaacttcgcagcacgatggatggcatccgtgaatccatctctgcggtcaacattgccgtggaagagagtgccaagggcattgcgggagtttccgagtcttccgtacagcttaccggtaacgtcaatgatatccaaagcgaggcatccgacaacaatggcatcgcagaggagctggcaacggaagtcggcaaattcaagcttgagtagagcttatataaagatggggaactaaaccaattcccgaatagaaaaatcgttcagaccgtgagtttgaacgattttttgtttaaggattatagatgtttttataaataaaatatggttacgagagagggcttctggctagggactgaacagtaatcttcgaacaaaaattcgagttacgagggcagactttgggactcgtaatgtgataagctagagccatcataagaaagaagcaaaagtcataaaattaaggttataatgatacaaattctgaaaaatgtgatattataggaataaggtatcaaattttgctttagtattatgttaaatgtaacatatcatttttttattgcgtgaattatacagaaaaggagaagttatttatgaagtacatcttggcattagacattggaatcgcatcagttggatgggcaatattggataaggaaagcgaaacagttatagaagcgggatcaaatatatttcctgaagcatctgctgcagataatcagctcagacgtgatatgcgtggggtgaaaagaaataacaggcgtcttaaaaccagaattaatgactttattaaattatgggagaacaataatttgtcaatcccgcagtttaagtcaactgaaattgttggattgaaggtacgtgcaattacagaagagattacattagatgaattgtatctgattctgtatagttatttaaagcatagaggtatttcatatttggaggatgccttagatgatacagtatctggcagcagtgcttatgctaatggcttaaagctcaatgccaaggaacttgaaaatcattatccgtgtgaaatacagcaggaacgcttaaatacaataggcaaatacagaggacaatcacagatcattaacgataatggcgaagttcttgatctcagtaatgtatttactattggtgcatatagaaaggaaattcaaagagtttttgaaatccaaaagaaatatcatcctgagcttacagacgaattctgcgatggatatatgcttatatttaacaggaagagaaagtattatgaaggccctggaaatgaaaaatcaaggacagattatggcatatttacaacacaattagatgccaatggagattatataaaaaaagctaatatttttgaaaaattaataggtaaatgcagtgtatatccggatgagcttcgtgctgctgccgcatcatatacagctcaggaatacaatttgttaaatgatttaaataatctgactattaatggacgtaaattggaggaaaacgaaaagcatgaaattgttgagcgtataaagaacagtaataccattaatatgcgtaagattatttctgattgcatgggagaaaatatagatgatttcaatggcgcaaggatagatgaatctatatttcacaaattcgaggtgtataataaaatgcgtaaggctctccttaaaattggtattgacattacggattattcaagggaagagcttgacaaaattggttatattatgacaataaatacagataaggaagctctgatggaggcttttcaagagtcgtcgattggtttgccagaagaagttaaacagtgtctcattaatatgagaaaaactaatggtgcattatttaataaatggcaatcattttcattaaagataatgaataagcttattcctgagatgtatgcacagccaaaggagcagatgacacttttaacggaaatgggtgttacaaaaggcacacgggaagaatttgcaggattaaaatatattccggttgatgtggttagtgaagatatatttaatccggttgtacgcagatcagttagaatatcgtttaaaatctttaatgcagtattaaagaaatacaaggctttagacacaatagttattgagatgccgagagatagaaatttagaggagcagaagaaaagaatcaatgacagccagaaattaaacgaaaaagaaatggaatatattgagaaaaagctagccgttacatatggtattaagctttcaccagctgatttttcatctcagaaacagctttctctaaaattaaagctttggaatgaacaggatggaatatgtctgtattcaggcaagacaattgatccaaatgatataatcaataatcctcaattgtttgaaattgaccatataattccgagatcaatatcatttgacgatgccagaagtaataaggttttagtttatcgttctgaaaatcaaaagaaaggtaatcagacaccatattattatcttaatcattcacatggtgaatggagctttgagcaatataaggcaacagttatgaatttatcaaagaaaaaggaatatgcaatttcaagaaagaaaattcaaaacttactatatagtgatgatataacaaaaatggatgtacttaaaggcttcataaatagaaatatcaatgatacgagctatgcatccagacttgtattaaacacaattcaaaacttttttatggctaatgatgcagatacaaaagttaaagtaattaaaggaagctatacgcatcaaatgagatgtaatttgaagcttgacaaaaatcgtgatgaaagctattcacatcatgcggttgatgcgatgcttattggttattcagagcttggatatgaggcttatcataaattacagggtgaatttattgattttgaaaccggtgaaattcttagaaaggacatgtgggatgaaaacatgtcggacgaggtttatgcagattatctatatggaaaaaaatgggcaaatatcaggaatgaggttgtaaaagcagagaagaatgtaaaatactggcactatgttatgcgcaaatcaaaccgtggtctttgtaatcagactattcgcggcacaagagaatatgatggtaagcaatacaagataaataagcttgacataaggactaaagacggaataaaggtttttgccaagcttgcatttagcaaaaaggatagtgacagagaacgtctgttagtgtatctgaatgatagaagaacatttgatgatctttgcaagatatatgaggactacagtgatgccgcaaatccatttgtgcagtatgagaaagataccggagatattgtcagaaagtattcaaaaaaacacaatggacctagaattgataagcttaaatataaagacggagaagtcggtgcctgtatagatatatctcataaatacggatttgaaaagggtagcaaaaaggtaatattagagagtctcgttccttataggatggatgtctactataaagaagaaaatcattcatactatcttgtaggagtgaagcagtcagacattaagtttgaaaaaggcagaaatgtaattgatgaagaagcatatgctagaatattagttaatgaaaagatgatacagcctggacaatcgagagctgatttagaaaatcttggatttaaatttaagctgtctttctataaaaatgatatcattgagtatgagaaggatggtaagatttatatagagagactggtctcacgaactaagccaaagcaaagaaactgtatagagactaaaccaattgatagggataaacacgaaaacagtaaagatggacgaaaaacaataggactttcaaaaacaaaattggtaaaaaaaattagaactgatattttaggaaataaatattcctgttcagaagaaaaatttacaggtttttgttaatatttattgacataacgtgctcttggtgataaagtatgtgtgtagagaaaattttatagtcacgtaaattatttagatctactaaaacaaggctttatgccgaaatcaggagcaccgacgggtgctcctttttttgtgtgttggagggttaaaatggcgtttagagttatacttatagagaatgaagtgactataaaggttaagctgaacaacctgattattacaaaatgtggtgaggatatatggattccgcttgatgatatatcaatgatagttctggataatctggcctcaaatttatctaccagactgatgtgtcagttagctgagcagggggtaggattgatgctttgcaatcagcagcatcttccgacaggtttttatagcgcatgttttgtatgtttgatttgcctgttgaaacagaagaacaaagaagaaattatagactattcaggaaagagcttattcaggaagggtttgttatgattcagtattctatatatgtcagagtctgtcctagcagggaatttgccaacagaatagaaaataggattaaaaaaagtctgccactggaaggaaatgtgcgtcttctttgcgttacagagaagcaatatgatgatatgaaactgctggttggcagcagacaaacttctgaaacagcaataggtacagaaaggctgattattatatgaatgtagaaattacagaatttgaaaaaagattttgctttgaattatgccctgttacgcaattgtgtggtcaaaatgttcgtaagaaaaattatatttttgaatcgttaagaagatactttggaacatttaaatattctgaatcaaaaaacaagtggagagataatgtatttatagacaataatcaggtaggcagaaagttctttagtgttctttccatcagtaataaaatagatattattcaaatgattaaaatgacagaacagagtcttctcatggaatatgtcaaaaatattatacaggattttgactggcagctgcatctgcgtaatttgagcgaagaaatagaaataatgtttcaaattattaatgatcaagtcaataaagtcggtgatatagagatatcgtatgctatgtctgatgtttgggatatggttcagaaatctgaagtgtcaggtattgatgatactgaattatctgataagtccaatgctgagcttatattaatattattgaatattgtagataatgttttgaaaaacaatcctaaaaagacattgattctttttgaaaatttagatcatttagtaagcctgtaagaatatattgaaattattcatgcagcagatacaatatcaaaaaaatatgatttatattttatattttatattctcatccagcttgaataagtatgtttgttgtgatatagattttcttgagggtatatctgtttttggtgatgtgcattttcaaatgcctgaatataacagattatatctattcataaaaaaaattatccttatgaaaaagaattttcaaatgaacatgttcagaaaattatatgcaatataatacaaagtattggacagtcaaattttttgaatactgtagaagaaaatgtagtatgtaagttgattaatcaaactttgctgttggatgataaaataccagatgaaaaaatgcctgaaatggcttttttaaaggcataatatatgctaaaataaaggttggagaaattagaatattaggttaatttgaacaagagacgtcttgtgatgattagatttgatattttagtaattgaataatttacgtgactgtaaaatgcgcttgagcttcctgcgtacatagacatattttagtaactaaataatttacgtgactgtaaaatcgctaacttactctatattgagcttgataaattttagtaactgaataatttacgtgactgtaaaatgtgttaaatcaagtccgtatctccttaatgattttagtaactgaataatttacgtgactgtaaaattgagtgtgtgcttcgcgctcaggcttgccaattttagtaactgaataatttacgtgactgtaaaatcgacgaattggtctgggaacttgggcagacattttagtaactgaataatttacgtgactgtaaaaggatactgattgcaatatgtctcatagaggaattttagtaactgaataatttacgcgactgtaaaagcaagtcgaaaatcggggaagcggtagttgaattttagtaactgaataatttacgtgactgtaaaagatgagtgcaaagtgttgccattgtcaagtaattttagtaactgaataatttacgtgactgtatataaaaccaagacaacaaacaatattatgtcagtgttttgttttatcaaaacccaaactagacgattttgattcattaaagtaatatataagaatgcgaagcagcttttcacagtttttagattatcgacacactgtgtcgacaatctgtaagcagtatacttatttcattgatgaatattatatgagattacgaaataaaagattttccactcgctgagtgaaaaaatcatctaacaactaattattaacaaatataatattatcaattctaacagaaaggatttatagtatggcagatttcaaatacgaaatagtagaacacataggcacactctcagaaagtgccaaaggatggacaaaggaactcaacagaatttcatggaatggcggagaaccaaagtatgatatcagagactgggcaccggaacacgagaagatgggaaagggtgttacgttgtctgaggatgagatggcgaagctaaaagacttattgtaaatatcatttgaattacatgggaggaacaaaatcatgagcaaagtaatagaagaaatgaaaaccagaagaagtattcgcaaattcaaaccggacatgattccgcaggacattcttgaccggataattgaggccggaacctttgcggcaaacggcagaggtgcacagaataccattattattcaggtgacaaacaaggaaataagggatgaaatcgctaagagaaatgccgacataatgggaagtaataccgatccattttatggtgcgccggttattcttatcgttcttggaaagaaggactggcctacacatgtctatgatggtagtcttgtgatgggaaacctgatgcttgcagcacatgatctgggtgtaggaagctgctggattcaccgcgcgaaggaagagtttgagtctgactggggcaagaagcttctcaaatcactcggtattgaggatgagtatgagggaatcggacattgtgctcttggatatgtcgatggagattatcctgacgtgattccgagaaaagagaatcgtgtattttacatataggagataaccaccatgaattttatatttgtagcattgggtggcgccgtaggtgcaatggccagatatgccatcagccttatacctttaaaaactgaatttccatttttgactttaatcaccaacgtaatcggagcaattctgattggatttattgtcggaatcacaagtgcaagggatggagtatccaagaatatggttttgttttggaagaccggtgtatgcggtggctttaccacgttttctacattttcgctggaatcctataatctgtttgaacataatcactgcctgcttgggtgcggatatgtgttgttgagctgtttaggatgtatactcggtgtgatgtgtggtgaaaaatttgctacaataatcaagtgacgagtatcgtgcggttttgcaaatgtgtgtggtgtgattctgaatagttacaatacaaattgatggggagataagtgtatatgagtgaaacggaaaacaatgagcagactgccgggaagcaatctaaggaacctaggagcaatcaaaagctaaagcttttgtatcttgcaaaaatccttttgaataatactgatgctaaccatgacattacgcttgacgagattttaaacaagctgcatgcatacgatgtcacggccgcgagaaaaagtttgtatgatgatatagcacagctgaatgattttggtatcaaaacccaaaagacgcagtatggcaggactgtccattataaggtgataggcagggcatttgagctggcggagcttaagcttttagtggattctgtcgcggctgccaagtttatcactgaggagaaatccaatgagcttattaagaagctggagagtcttacaagcagacaggaggctgccactctgcagcgtcaggtatatgttgccggaagagtgaaaatcatgaacagcgacatcatgaaaaatgtcgatgccatacacaatgcaattgcaaataattcaagtctttcgtttcaatattgccggtggaatatgaaaaaagagcttgaggtgaagcatgacggcgcaagatatcatgtcagtccatggggattgctgtggaatgatggcaattactatctgattggatatgaccatgatacacaggtaaaggatattcatcattaccgtgtagacaagatgaagaatatcctgattgaaaataaagtccgtgagggcagggagaagctcaaaaaactcgatattgcttcttatggcaaatcgaagtttggtatgtacaatggagaagagattaaggctgagatactgtgcaaaaacagcgctataggtgtcctgattgacaggtttggaaccgatgtgacaatcttaaagaaggatgaagctcattcgagtgtttttgtgaaggtagctgataacaagctttttattcattggattatggcaatgggggataattttaagataattggcccggagaatctggtgaaagaggttcatgatgagcttaacagactggcaaaacaatatgagcttgctgactaaatcttgaagaaagtgccatattgggaaaataaaatcttgaagaaaatgccatattggggaaataaaatcttgaagagaggtatacatgagtattttaaacgtagagcatctaagccatggttttggcgaccgtgctatttttgaggatgtttccttcagactgttgaagggcgagcacatagggcttgtcggtgcaaacggtgagggaaaatcgacttttatgaatattatcacaggcaggcttatgcctgatgagggcaaaatagagtgggcaaagaaggtgcgtgtgggttatctcgaccagcacacagcgcttgaaaagggtatgactatcggctccgttctttcctctgcatttgatttcctttatgatatggaaaatgagatgaacgacatatatgcacgtcttggcgatgtggacgaggacgagatgaataagctgatggaggaagccggcacgattcaggacatgcttaccatgcatgatttctatatgatcgatgcaaaggttgaggaggttgcaagggctcttggacttttagacctggggcttgataaagacgttaccgatttaagcggtggtcagagaaccaaagtgctgatgggaaagctcctcttggagaagccggatattctgcttttggatgagcctacaaactatctggacgtagagcatattgagtggcttaagcgatatctgaacgattatgagaatgcgtttattcttatttcgcacgacataccgtttctgaacagcgtggtaaatctcatctatcacatggataataagaagctcgacagatatgtcggggattatgacaagtttatggaagtctatgagatgaagagagcccagcttgaggctgcgtacaacaaacagcagcaggagattaaagagctgaaggattttgtggcgagaaataaggcgcgtgtagctacaaggaatatggcgatgtcacgtcagaagaagcttgacaagatggatgttattgagcttgctgctgaaaagccaaagccggagtttaactttaagacagcgcgtactccggggcggtatattttccagacaaatggtctggtcattggctatgatgatccgctttcatctgctctcgaccttgagatggagaggggacaaaagattgttcttaccggtgcaaacggcatcggaaagacgacattgcttaagagtattcttgggctgataaagccgctttcaggaagtgttacacttggagattatctggagatagggtactttgagcaggagatggatcagtcggttacaaccacatgtattgaggagatatggaacgagtttcctgcattttcgcagtatgaggtgcgaagcgcgcttgccaagtgtggcctgaccacaaagcatattgaaagccaggtgcgtgtgttaagcggcggtgaacaggcaaaggtacgcctgtgcaagctgataaacagagagacaaatattctgcttctggatgagcctaccaaccatctggatgtggatgctaaggatgagctgaagcgtgccttaaaggagtacaagggcagcatacttatggtatgccatgagccggatttctatgatgggcttgcgacggatgtgtgggattgttcaaagtggactacgagattatagatttataaattatgaattagatatgcatgccttttaagacatagatatttagagcaggagatgatttttatgcatatcagtatacttttaatggaacagataatagagctttttatcatgattttcatgggctttattatcgtgaaagcaggtattgtgaaggatgaggacagcaaggttttatcaaagattgtgctgtatctgattataccgtgtgttattatcaatgcctttcaggtggattacacttcaaaaacagtgagaggtcttttgattgcatttgcggcatcggtgattttgcagttagttttgctgtttatcatttctgctatgggcaggcttttccatatgaatgaggtggaggtcgcatcagtttattattcaaattcaggcaatctgattgttccgattgtgacatttatactggggcaggagtgggtgctctacggctgtgctttcatgagtgtgcagctggtatttttgtggactcactgcaaaaagattataagccgtgaaagctcctatgactggcgaaagattgtccttaatatcaatatgatttccatagtaataggtgtggtgcttttctttacaaggattcatctgccgcagcttatcaatgacacaatcggttctgtcggcagtatgattggacctgccagcatgattgtgacaggcatgctatttgcagggatggatttgaagaaggtttttgccaacagaagggtgtattttgttacctttctcaggatgcttctggttccgttgatatcgcttattcttattaaaatcagccatatggcatatctttctgcagatgcgccaaagattatgcttattgttttcttggcggttattacgccttcggcatcgactgttacacagatgtgtcaggtgtatggcaatgattcaagatatgccagcgcaataaatgtagtgacaacgctttgtgctgtagtgacgatgccggttatggtgcttttgtatgaagaatttatataaaaacgaaaagtcatgaagcacgtttttaaactagaaggtcatcacacagtccctggtgatttcatcaagcgaagatacaccacacatcttcatggtgtcttcaagctctgtaccgattttgtctatgtatgcacgtacaccatcggccttaccgccgtatacagccgttacaaatggtcttgcgataagaactccgtctgcacccagtgcaagggctttaaagacgtctgtgccgcttctgatgccaccatctacaagaatcttaatgtctgagccttcaagagcctttacgatgctttcaagcacctcagcagtggcaggacactgatccagcacacgtccaccgtgatttgatacaataatagcgcttgcgcctgcctcttttgctttaagcgcaccctttacagtcataattccctttacaataaatggggttccagccatctgtatgatatcgcaaagctctgaaactgttttgcttccggctggcggatcaagatttttgaggaatggaagaccggctgcatcgatatccatagctactgcaaatgcgcctgattcatgtaccagctccattttctcacgtatggtctcaatgttccatggctttacggtaggtattcctgcaccatctgcatttttgatagccttggtggctgcaaccatgacatttgggtcagttccgtcacctgtgaaagctgcaatgccgttctttgcacaggctgacacgaggatatcgttgtatgtcacatcatccagacagtctctgtagtgcagctgtactgcaccgacaggacctgcaaataccggatatttaaaagtacggccgaagagtgagaaagcggtgtctacaggcttattttcggcaatagtatccatgtttacacggatttgtttccatttgtcgtagttgcgtatggctgtgtcaccgatgccctttgagcctggaccgggcatctggtttttgcatgcgcggccgttgcattcaggacaagccttgcagtattttccaagacgtggtctggcattttcgatacattctgtatagttcatatttttcctccaagtgtaaatctttttaaattttattattgagattataacacgataatttttttatgtatacaaaacaggtgaaaagctcttgacttggagtggactccaagtgatatagtttcattgtaacaatcaaaaaggaggcgcttatagaatatatcaggctttttcagatgggagatgccacatttgaagcaaggtgtcagcttctcaaggagcaatacgagcagcttgatgagcagaaaaaacagattgaaaacacgatggaacgcttacagtataaaatttctaaatatgagaatgcgataaagacaggtgaattgacctgggacaaataggaggacaaaatataatatgtatcttgagaaaattaacggaccagaagatgtaaagaaaattaagatagatgaactgccggtgctggcgcatgagataagagatgcccttttggtaagagcaagtaagcatggcggacattttgggccgaattttggaatggtagaggcgacaatcgctttacattatgtatttgaatcacctaaggacaagattgtttatgatgtatcgcaccagagttaccctcataagatgcttacggggcgtaaggaagcgtatttgtctgaacagcactatgatgatgtgtcgggctatacaaatccaaacgagagcgagcatgatttttttacagtcggacatacatcaacgtcggtcagtctggctgcaggtcttgcaaaggcaagggacttaaagggtgaaaacggcaatgtgattgctgtcatcggagacggctcattaagtggaggagaagcacttgagggacttgattttgctgctgagcttcaaagcaattttattattatagtaaatgacaacgatatgtcgattgctgaaaatcatggaggtctctatcagaatcttgctctgcttcgaaagactgacggtcaggcagaatgcaatctgtttaaggctatgggacttgactatgtgtatgtggacaggggcaacgatgttgcagctcttattaaggcatttaaagaggtcaaggacagcactaaaccggttgtagtgcatataaacacacttaagggcaagggctatgcaccagcagaaaaatgtaaggagcagtggcattacagcggtccgttcgatatagaaacaggaaagccgctatttgacaatgtggaagaggattattcttctgtgaccggtgaatatctgcttgaaaagatgaaaaatgattcttctgttgttgcaattacttcaggtacgccgactgttatgggctttacagaggataagagaaaagaggctggcagtcagtttgtcgatgtaggtattgcagaggagactgcagtggcactggcatcaggtatcgcagtaaatggtggtaaaccattttatggtgtatacagttcgtttgtacagagaacctttgaccaggtatcacaggatgtctgcatcaataacagtccgattacaatggtaatatatcagggttccgtatatggaatgaatgacgttacacacttaggttttcaggatattccgatgctttcaaatattccaaatctggtttatctggcaccggcaacaaaggaagagtatctggccatgctcgactggagtatggagcagacatcttatccggttgcaataaagctgccgggcggaccgatgatttcagatggctcaagggtgacaaaggattttggcagactcaatagatatgaggtggctcagacaggagaaaagattgcgattatcggtctgggaaccttctttgaactggcaaaggaggctgcgaaacttcttaaagaagaagccggaatcaatgcaactgtaatcaatccgtattacatcaccggattggatgaggcgcttttgactaagcttaagcaaaatcatgatactgttattactttagaggatggtattttagatggcggctttggtgaaaaaatcgcacgattctatggtgcaagcaatatgaaagtgatgaattatggattgaagaaggaatttcttgacaggtatgatgtggatgctgtgcttaaggataatcatctgactgcagagcaggttgtggaggatgtgttatctatttcataataaaatcataaattccaaatataaaagacggctgatttttcaaccgtctttttataaaatttcaaagcttgtgttgaagcatactaaggtactgcaagcggagcggtactaatttttagcggtacacatttattcgctaaacacaagtttaacgaataaataacatcataaatagtaccatggtaccacgcaaaacatatatctgcttattttttgcataatacctgcaatttcgatacgtacaataatattatgattaaatggtcaaaaggtatcatcgaagcatgcatcgatgatacctttttttataataatacaagaataagccaccgaaacctctatttgcatcagttccgatggctttaaatccatagctttctatacaacaatacaattatttattatgcaattatttattgtgacttctcatgcattccctgtatttaagtataagctcgattgagtcctcaactgatatctggcttgtgttcaggcacaaatcatagcttcttgcgtctccccattttttactggtgtagtaattgtaatagcttgagcgctctttatcttttttcttaattatgtctttagccttgttctccgggacattgagtctttcacttattcttttaattctgtcgtccatgttggaacgtatgaagatattgagacaatgcggctcgtctgctaaagcataatctgcacaacggcctacaataacacaggattcatttgccgcaatctttttgatagcatcaaactgtgctaaaaataccttgtgattcagaggcatatcaagaaacggtgctgtggaataagagccacctgtgtaggtgtccatgaccagcgaatataaaaagctgtttgtaggcttttcgtcatgcgactcaaatatttcctcgcaaagtcctgattccttagctgccttctgtaagagctctttatcataaaatttaattccaagtcttttagctaaatcttgtccgacctgttttccgaggcttccaaattctcttcctattgtgtaaatttcgtttgatcccataattcagacccccttatataaataattaatactatatcactatgtgataattcaatttatttgttatttatattatataacacttcaagcaaattggcaaagtattttggtaaaggtgcatcaaattccatgtattcaccggtttttgggtgcacaaaccctattgtttttgcatgcaggcactgtccttccaggcctttaaaccggtttttggtaggtgaatagctcgaatacagcatatctccaagcaagggatgattaatacttgccatatgcacgcgtatctgatgtgttctgccggtctcaagcttaaactgcatatatgtatagtcaccaaagcgttcaagcaccttataatgtgtgacagccggctttccgtttttctcattgatggccattttcttgcggtcattgggatttctgcctatggcaccctctatggtgccctcgtcattctttacattgccacagacaatacccacgtatatacggttgcagctatggtcctttatctgttccgatatctttatatggctttcatcgttcttgcagacaataagggagccggtggtgtccatgtctatgcgatgcactataccgggccgtatttcgccgtttatgccacttaaagagtccttgcagtggtacattatggcatttacaagagtatcgctgtaatgccctgctgaggggtgtacaaccatgccctttggcttgttgactaccagtacgtcatcatcctcgtagagtatgtcaagaggaatgtcctgtggcaggataggtgtctgtacggcatcaggaattgtgacatctactatgtcatcagtctttagcctgtaatttgccttttggggcttatcattgaccagtatttgattttcttttagtatccgttgaaaaaaggagcgagaaatatccggataaatgctgcttaagtatttatccagtcgttctccctcctgttcactctggacttcaaatgtatctctattcatagtgaagctttctctttttttattttagtaactatttaaaactatattgcacactttaaaaagcgcataccgcactaattttcatgctttccatcatgctttctatcagggaagattaaggaaaaatcctcctccttgtagtaaaacagcccgagtatgataaacataaatgccgctacagtgacgtatatatcagctacattgaatatcggaaaattaatcaggctaaaataaaagaaatcaaccacataattatttacaatacggtctatcagattgccgagtgcacctgcaataaacagtattacaacaacattcagcagtctaaaacgttttgagacaggtattttgcgataccatacacacaaaagtataacaactgcaatggtaatcactgagaaaaaaatcattttggcacgcaaaaatgccaatggattctcagaccaatatgtaaaatgaaagatattctgtattattgaaagcagatcaacaccaaatgcagcactctggttttccaggtatctgaactcgaaaactcccggaatgagaacaaacacacccgtggacgattgctttagatttataacagccagatactttgtaagctggtcaattgctacaagaatcaatgcaatgatgcctgctgtacacatttgtttttttgttttatttttcttcatagctgattagagactccgcttaataagatgaacccgggagatcaaatgaatccatgagactctggatatctcctgagatatctactccgtgtggtgtggcgatgaagataaagttggatatcttctgcagattaccatgcagggcatatgctgagcctgatgtgaaatctatgatgcgctgtgccacatcgacattaagtccctccatgttgatgacgactgtacgtccgttaagtaatgtgtctgttatttctatttcgtcttcaattgaacttggttttattacgcaaacttccatgtctgatgatacctgctttctggatgattttgatattggtgtaatcttggatgtagtcttaacaggcttctcctttggtgttgtatcacgccttgtgctttttatggtcggttcctcttcagcagcctctttttttctgcggaaaggatttcttggaagctcttcttcttcctcatcatcgaggtaataatcctcgttatcgaactcctcatcgtcctcagaatttaaactcattttgtcaagaatcttatctatgaaactcatttctatattccttttctatttttattttgtgtatagcatatgcaaagtatcagttagccttgctgtagtcgcgctctccaaatattccggtaccgacacgtaccattgttgcgccctcttctattgctactgtgtaatctcctgtcatacccattgacagaacattcatactgacattatctatgtttttttgtgctatgtcaactgataattgcttaatatctctaaagtattgtctgttatcctcaggatcatctacaaatggtgctatagtcataagtccttttatatggatatggtccagtttagcaatttcttcaactaaggagatagcctcatctcgtgatgtgccaaacttagatgcctctcctgcaatattgacctcaaccagtatgtcgcagctacagtcatgctttatggcctgcttttgtatctcctttgccagatgcagtgaatctacagagtgaataagtgaagtttttccaactatatacttcaccttgttggtctgaagatgcccaatcatgtgccagtgaatatcttttggcataacctccatcttttcacacatttcctgtaccttattctcgccgaactcacggatgccctcatcgtatatctcactgagcatctcaacaggtttggttttgctgactgcaattagtgtgacatcactatagtttctgtgagctctgtcacatgcggcctttatattttgctgaacctgatgtaagttgtcttttaacataaaatctgtcccttctgtatattttatcaatatttattaccaataattatttggttatggtctggttttccttcacggatttgccatccaaggctatatggtcataaagcgaaatgccatatggcgttttggcttctacaattgtgtagtcatcgtttgatgcaagtacctttatctgcttaaacacagcgtatcctttgttgatattgtaaacccctgtgagcttgtccttatctgttcccaccctgtaggttgacgaagaatcaggctttacaatgatatcgccgtccttaagatattcatcatctacgaaataaaagtcatcattctggctgaatattgttggactgactatattaactgagccactgcttttatcctttatcatgagtgacgaatcatcggaatcgccgcttgcagtgaaataatccttaggaatagtgaaaaattcctttttggttatagctgaattaggtattttaagccctgtgtctgctccaagcacgagctctatattggtaaaacgctcatttatatagcggatgagcgagtttttcatattcagtttcaggaaaaaagcatcatccttcttcaaaaggctgaacgataccgtggttgtatagtcatcatcgcagaatctgatttttatgactgacttgtcattcaggctcttggcaacattgtcaggaacatttatgagtatattccagttctcacttgtaatcagcttataaacaggatccagctgattgatggtgctgttgttggttaaatcagtctcttcataattagtgttgttgtactgatccagagtgaagctgtctgtagtgacatcctcatagccgtctattccgtaataggctattccgggagctgtcggcttatatgtatagaaggtgttgttagcctcagcagtacttatagtatctgccaggcttgtcagtgcattttgactgagaacctgtgtcagctgtgcagacagatcgtttttgaaggtataaacctttgaaaagtatcgtctgttgtagccggatgaaaagctgtttatgtcagtgataatcttcccggcatcctcgtcagtgatggcggaagcatcattttgagcaccggtaatctgggttgcaatggagccgtctgtatcaacagagtagacaacatcacttgttgcaacctttgagccgtttgacacaaagtagttgaggtttcctgattcctcagcatacactacactttcctcgcggattatcatgcccttatatatgttgttggtcgctatagtaccctgttgtacctcgtattcagataccgggtttgaggtgaaatatgtaaatatgtgaaaaatcacatagattattattacaaaaaacactataaaaccgatattcagattaaagccggtgtgatatttcagtacttttttattcttttgggacacaattttactccttaaaaaagggatgtgaaatacacatccccctaattaatcatttataaagaaatgataacctttgccttggcacattcaggcaacttgtcaatattccttgaaacacttaagatgaacttcaccttaaacttctcgctgattatatcaagcttttcgattgccttggtgatatccccctcatcatcaagtgatgcaattgtaaggaagctgtctaaatacatctcctccagatcatgatcctgcgatatgattccgcatataaatcctaaaaattcatcacaattgtcaataggatagtccataacattgattagtcgaacctggttattaagctcatacatgtgcttctggctcttatcaagaaaaactatggaaccttcatttcccttaattgatgaatttaccttgtctaacagctcttttgtcttgcccttgcccttgtctccacaaataatttctatcatggctcattcctcctatggataaatattgtgattattaataaaaaataattgtatttttatattattatagtataaataaccataaaactcaatatttaattagcaaatccactaagtatttcattcatgaagctataaagatcctttttaccatctgccttgtaaactatgcttatgatgcgctcatttttagcattctggcttagcagtacgaggcaatgaccggcttctcccgtagtgcctgtctttcctcctgtcactgtgacgttttcaggggctgtatatgctccggtcagatagccgcaggtattcttaaaggtctttgaaacagccgcgccctgggcatttgtatatgccacatcatgggtctgtgaactgatgattgcaacaaagctctctaaggatatggcattggaaaaaatgaggtacatgtcatatatggtagtgtaatgattttcatcaggaagaccgcttgggttgacaaaattgctgtttgtggcaccaaaactttttgcagtgctgttcatcagcttggcaaattcttctacagaaccactgcagtactctgccagtgctattgccgcatcattgccactctcaagtaagagcccatacaataagtcctgcactgtaatgacatcgccctccttgaggccgcatacagatgatgaatggccagggtttgcagcgtcatggcttactgtgactgtcgcatttaaatcacagtttttaagaattatgtatgcagttaaaatctttgtagtgcttgcaggatagagcttttcaaacagattctggctatacagcacctgatgagtgtctatattaaaggctccggctccctctgcggtttttgcaaactgcatattgtcctgaccaaaattgacatcatttgtgacgcaaaggttggacgcaaaataattacttccgttgtatccatttatataatcggtggaataagtatcatatgcattctcaatctttgtaccacagcctgtcataaaaaccgctgctatgcatgtcagacatagcagtcgtttaattctttgtttacttgtacatctcacgccagtcaagatctcctctgtccaatgataaaatgagcagctctgctgtagccagattggtggcaagtggtatattatgctcatcacaaatacggaaaatactgtttacctcaggctcgtgtggcttaggctttaatggatcacgcagaaaaatgacaaggtctatgtcattgtgctcaatctgtgctccaagctgctggatgcctcctaagtgtcctgcaagatatttgtgtactgagaggtttgcaacctcctctatcagacgtcctgtggtgcctgtggcgtacaaattatttttgcttaagatacctctgtatgctatgcagaagttctgcatcagttttttctttgaatcatgtgcaactaatcctatgttcattgctaacctccctatgaatatttcctcggctgtaatcctacattcaggacaattcccattcccatgtacagtgaaacaagtgatgtaagtccataactgacaaatggaagagtcatgccggtattgggcataagacctgtggctacgcacaaattgataaaggcctgaaagcctataagtgctcccatgccacagcatatgagctttccgcttgtgtcctttgccttccttgctataagtatacactcaattacgataagaagcaaaagaattattatactgattgtaccaataaagccaagctcctctccggcaacagcaaatataaaatctgtttgaggctctatgatgtagttggtgttcttcatagaggttacaacagagttgttaagtcccttgccaaacaactgtcctgagcctatagcccagatagagttcctttgctgtgctgctgtatcagcgtaatttgtcgggtcaagccacgacattatacgtgtagcagggtaaaagccttttttgatgagtgcatcggcatgtgtatatatgtagcttatcactatcaaaactatcggtactgaaactccaagtaccggcattattattttataacttaatccgctaataaacaagagggtagcgaaaattaatgcagtaagaattgttgttgagttgtccggctgttttaagataagaaataaaggtataccggcaaaaattacagataatgcaagagttcttactgtatttatactatcctcaaacctggaaaagaaataagcaaaaaacaaaataagtataattttcgcaatctctgacggctggaatctgatacctgcgatctcaaaccagcgctgtgcaccctttgcatcatcacctgcaaatagaacaagcaacagcagcacaatcattccggcatagtatatccacacgaatttgagcagaaatgtgtaatctataagggaaagcactatcataatagtcagtcccattacaaagcctattatctgcttgctctgtacggagtgcttggcactgcctatcagcaggatgcctataatcgacaaagctattatgtatactactaattgaaagtgataattctttagtctgtactgtttgagcattttgttacttcctatctgttatctttgtaatcttaattctaatactaatgatatgatggtcaaaaggtattttgttaaaggttattaattgattttttgtcgcgcatgataatccggacctcataagcttcatcgtttatattcatatgtctttgtatcacgctttttatctcttttttaatctgtgtcatattgtcagaagcagatattgtgctcctatcctctgcaagtgctattttaagccttttctttgcgtattctcctgttttggaaaatttatgcatcatacagcggcacctctcatatcgtcagaggaattgattatctgaccggatatatgggcaaatacaggagcaagcctgcttttggcctcacggacaggtattcctctgttctggcaaatgataacacttttgtcatagggaatagtgccaataatcctggtagaaagaagtgctgtaatatcattatctgatatcatctgatgccttcttaccatatgcttgtcatatgcattaacaatgactgatatatcgtcaagatgtgcgctgtcgagcaggcttatgcatcgccttgcatcgtgtatggcagatacatgcggtgtggtaactactatcgcgcggtctgccggtgcgacagaaaaccaaaagccactgtcgatacccgccggagaatctatcagacaataatcaaagcttgctttaagctcctctataagtatcttgaagcgtgcctcatagctgcatagcgtatccatggaaggtgctgcaggaattacatatagattgggatattttttattgcgtatgattgcctgtctgatacggcatgagcggtttaggatgtcgaggatattgtaattgaccttgtcctctattcccattaccaggtccagattgcgaagtcccatgtctgtatcgagcatgatgacttttttatctaactgtgaaagttcaactccgatattggaaataaccgtagtttttccaacaccgccttttcctgaagtgaaaactattgcttcactcacaaaaataaacctcctagtctgttctggcacttgagcctgatgagtatacaccctcagccttgactgcgagtaaatcgtcaagtgactccagattataataatatgaaattatatttctggatgcagctgcagcattgtgtgagctgtatccagatgatatacgtgtagctattgtaatttcaggatcgcttgatggagcgtatcctacaaacagtgcatggtttggtcttgtctcaacctgctgtgctgttcctgtcttaccggacacctcaacgcctgtaaagccgccaaatacatcgtgcaggtcttcgaccaccatacgcattccctgatggatggcatcccactggctttgagtgagtgtgcctgatatatcggttgattttgaatcatactgtttgactgttttgccgtctgcattcacaattttgttcatcagcttatagtcataaagctttccggaagcaactgctgtcacatatcttgaaagagaaatagtcgtaaagttgttattactctgtccgatggctgccataacaggatactgtgtggcaatggacggcgtcttttctactatctcaacacctgatttctggtccagtccgtatatagatgcatatttttgtatgtatttcataccgttttcatcgtcatatgaaccggtgtccttgcttgcaagcctgaagcctgttgtgtagaagaatacgttacatgaatcccttaaagcttcagatacattgtccataccatgcgctccaggataaatccagcattttggctgattgctgatttctgtaaatattccggtacaattaatctttgacgaagtatcaatgactccctcggcaagacctgcggtgcttgataccatcttgaaggtagatcccggtgcagtctgctcctgggttgcataattccatagcggattagacttgtcctctctgagagactggtagtaatcagcatctacagtgtttgcaagcttgttgttgtcatagcccggatagctgactaaagcctttagctgtcctgtctttacatcagttatgacacaggagcctgtacatgggtcaagggcaagctgtgcaggtgttatctctatattgtttattttgtccataagaaatgcatatggactgatggagccattagcaatgttgcttactgttgcatcgtcataatcgagtacaccctggtcaaaaagcagaaggcacagctgctgtccagtgaccgctccggaatttaccatatatttgtatataattttggcaaagtctttattgtcagtcatggcatcactgatatacgaacagagtgctgtgtaaatctcgcttgaatcagcatacttctggtccacatcaagctttgttatgtctatccactgctttgaaatgcagtatttgagataatcacgcggtgagagtgtgccagccttccatgaagcatatgtggaatcagaggtatctatctgtttgctcaatagcagtccatcatcgtttagcactgacataacacatgtaaaataatcaagtgtctgctccgacatggaagcagtgcctgaagtaccactttcaagctcgctgtcaatagtggataatgcattctgcagctgaccgctgaaggaattgtatatagcctgctcagttgctgatgcatctgatgcattgaaatgtgtcaggtcaactacattgttgttgatcagtgcaaagtaaacatcacttataggtatttcaccggattttattttggagtaaacaattccggctatctcctgctctaacagcttgtatgtggcctcctgcagcttgatgtcaatacttaagtagacatcatttccggaaacaggattctcctgacttattacctcgtttatcttaccgacattgtttacatagacctgtttttcaccgtttttgcctcgcagatagctttcatagtactgctctaagcctgacttacctaccatatcattttgtgtatatgagtcatcatcctttgacagctcattatactcgtcggtagatatcttacctgtgtatcctatgagcgatgaaatatattcaggatagttgtacttgcggatggtatcctcctcaactgatatgccggtaagagtatctgaatgctcattgacatatgctactatcgaatcatttacatcctttgcaatagtagtggttttgtatttggtgaatcggttctgttttatggcatatctcatcactacaatatcataagtggcctgtgtatcatacttgctgcttatatcaaagcattcattctggtcagagcttagaaaatcaataatattctgggcgctggcatttgcctcgtcaaatccaagtgctttattgtattcgagcttatcatatttctttccgaatacatctgacagaaatctcttttttgaggtttcagatgtgaatgtaaagctgtatgtaccatcatcgtttaaaacaaccggaaaatcattgtatatggagccgccattgttttttatcacattgataatttcattaagctctttgtttaaaagacgattgtgctccttcgtagatgaatagctgccgttgtctgagatgactacagaatatgcaagctgattgtaagcaagcagctcaccatttacatcgtatatattgcctcttgatgcctctatggaaagcggctttttaatcagcattatgaagtttttctgataatctgcacctttaataatctgaagggtaaagactctttcggcaagcagggcaaacatgaaaataattactgctgccaagacaaaaagtcttgagctgaaaaatttcttcagaaaatcttttatatcataaatcaaatttctttgctctccttttctcgtgtgcttccagcttctggtttaacttaagaaataccagatacaaaagtatactgataaccattgtgtatacaaattcaggtatgataattgacttcagatagtacaaaaagctaaatctgccacgcagtaaaaacatgaaaaagtatactaccagattgtaaaacaaatcgctgcctcctatcagaagcataggaagctttatatcgtcaggatagaatcttttttggaataatccattgataaaaccgatatacatatatattaaagcatacagtcctatataatttccgcaaaatatgtcaataagcaggccgcaaaagaagcctacccacagtccttcctttttgccacgcataaagccaaaggatgatacggctataatcaacaggtttggtgagatattggcaaaggaaagagtcttaaacagcgtggtctgcaataaaaagcataaagttattattataaataaaacaattctacgtctcatgctgctccttacttattttcagttgaattttcagtctggctgtcaccggctgtttctgtactttcggtgtcgtcagctgtcttagtgtcaccggtctgcttaagctgtgttatgaccatgacattttcgatatgctcaaaatctacaactggtgtgatagtgccggattttgtcagattgttggaattattttcgatttttgtcacatagccaatcagtatgccctgctggtaacggtctgacacgtatgaggtaactacaggatcgccctcttttaccttgttgtcgtcatcctttaactctgtaaaggtaattaccttgtcctcgttcatggtttttatattgccactgacggtgaggttgtcctccgtggtggaaaccatgccactgaccttgctggcatcatctatgatacagcgtaccttggcaaaattatcgccagcatcggtaacaatacctacaagtccgcttcccgcaagcacattcatgcctacgtccactccatccttttttcctttgtcgatagtaaaggtagaaaaccagtttccgctgtcctttgctatgacactggcagcgaccttgggatatgatggatatttggcatccaaatcaagaagctgtctgtaattgtcaagctcatactgttcaagtttggtggttgtgagctgtgttgtaagctcttctacctcggccttgagctttttattctcagccttgacattttttaatgtgcgtatttctgtaaccttatctgaaatgtggattccaaagctgtttatacctttctgcattgggatgaatacatatccggcagcagtctttaaaggaccaccggagatatttaaggtaaggcttaacagcatggtcacaaagcagactgctgtcataatcaacagtgtgtatcttgcaggcagctttttattgtgctttctctttcgattgcgaaaattcttactcatgttaacctcggttattattttttgatgctgaacggaagtctcttatattttgaatcagaaactatttgtacgagtccgcgtactgcactctcctcaggacattctgagcagatgacctttatacctgtaatctgttcaaagagctggtcaagtcctgtaagctgtgagccgcctcctgtgatataaatgcctgaatggatgatatcctttgcaagctcaggcggagtcttctcaagaatcatttttattgatgtgcatatagactcaaggtttgacttcatagcctcgtaaacgacctttgaaccaatttccatctcaataggcaggccgcttaccacatcacgtcccactatgaccatactgtcctctcttcccggaagtgcagaacctatggtctccttcaacagctttgcagtcttttgtccgattacaagattgaactcctttcgcacaaaggagatgattgactcgtcaagtctgttgccaccgaaatgaagcaggtcactaagcaccaggccaccgagtgaaataacggatgtctctgttgtgtcagcgcccatatctactatcatgacaccggttggctcgtttacatctattccaaggcctacagcatcagcgataggcttctcacagagcatgacctttttaggctttgatttgctcttatagaagagctcgtagaatgctcttttctctacatctgtgatatctgtcggcacagcgatgatgaactcggcatttttgatacgtgcctttgtcttgtgctccaaaaagtcaaaaatcatagtctgaagcagattatagtcagcaataactccctctacaacaggaaatatgacgttgattgtctcaggcgccttttcatacatggcatatgcactgtctccatatgcatatatctgatttttgtctattacggctattgtgtttttctcaagcattgtcttgcctgtagcctttgagtataccttgaaattgtttgttcccagatcaattccgtaaacgttgttgctcataataattctacctcgtcttctgtttatataagtttattttcatagaagctataatattcgttatctccgattatgatatggtcacaaagctctatggaaaaaatccctgagccctcaattaatctgtctgtgacagcaatatcatttctgctgggagtacaatctccgcttggatgattgtgcaataaaacaagctttgatgcatttttatccagggcggtcctgatgatggagcctatgtccactacagatgagcttagtgaacccttggatatgaacttgtctcctaagaatctgcttttcacatcaaaataggcacaaatgacgacttcatttgtgagatgcctcatctgctccatatagtagtcagctattgtctgaggattattcattctgatgctttgaaccttttttgtctttgctatgcgaagcgacagctctgctatcgccttaagctgtatagcttttatctgccctatccctgggatactaagaagctcctcataggacatctcatagagattgagcagattgccatgcctgccggaaagtatgtcctgtgcaatatcaatcacagtcttgtctcttgtgccggtctttataatgatggcaagtaaatcagcgtctgacaggcctgatgctccaagcgataaaaatttctcatatggtcgctctgaagtcggcagatttttaattgttttgttattatgcattaatccctttcgcttctcccaggcgattgacaacggatttaagcaaagttttcagttaattgtagcacacctaatccagcttaacaagatttctctcataaagtttttgtaaagacatcaaaattccaagctttgcatggtaccatgtgagtcctccctggaaataaaccgcatatggcggcttcacagggccatcggcagaaagctcaatggatgagccctgcacaaatgcgcctgctgccatgatgacatcactgtcatagcccggcatagcccatggctcaggggtcacatagctgtctacaggtgctgctgcctgaatgccctcgcagaaggctatcatggcatcgcggttattgaactctacagcctgtatgatatcgtggcggctttcagtaccgtcaggaaccaccttaaaaccaagcttttcatagatttttgcggcaaagattgctccctttaatgctccgcttacgacagtcggtgcaaggaaaaagccctgataaaatgactggatgactccgagtgaggctccaacctccttgccaagtcccggagatgtgagacggtatgcggcattttcaacacattcctttttgccgacaatatagcctcctattggtgcaagtccgcctcccggatttttgatcagtgagccaaccatcatgtccgctccaacctggataggctctgtatcctcgacaaactcaccgtagcagttatcgaccatacagatcacatcaggctttatgctctttacaaaggcaatgagttcgcctattcttttgaccgaaagtgtaggtcttgtagcatagcccttagagcgctggattgtgacgagcttcgttttttcattgatggctttctttattccgtcatagtcaaactcaccgtcaggcagtaaatcaacctgcgcatatgtgatgccgtactcagcaagtgagccctttgaagggcgtatgcctattacctcttcaagtgtatcgtaaggctttccgacagggcttaaaagctcatcgcccggacgcaggtttgacatgagtgcaagtgcaagtgcatgtgtaccacaggtaatctgaggccttacaagtgcatcttctgcgccaaaacagtctgcgtacactctctcaagtgtatcccttccgaggtcattgtagccgtagccgcttgatgcctggaagcactctgcgctcaccttgtttttctgcatggcggctatgaccttaagctgattatactcagcatttgtgtctattttgtcaaaacgctccttaagctccttttctacagagattccgaaatccaaaacctcctttgatattccaagtgtctcatactgcctgtaaatggcttcattggtatctaacaaattataatcctcttttctgctaaaatttcttgtattttatttaatattttattatcatcatatgaatattcatttttttctatccatatggtatctttttctctcctaaaccaggttagctgtctctttgcaaaacgccttgactcaagctttaccttgtccacagcctcatcaagtgaatattctccatcaagatatgcaaggatttccttatatcctatacccttcatggataccatatcgcttgtacagcccattgcctttagctttttcacctcatcgacaagtccgtttgaaaccatgatatcaactctcttatctatccgctcatagagtctttgtcttacatcatccagtacgaaataggcaaagctgtatggagactgcttggctctttcagtctcattgtgctttgaaatcggctcatggcaggtgtgatagtattcaattgccctgatgacgcgctttacgttattctcatggatgctctcgtaggatgcagggtcgatatccttaagcttttcatgcagtgcatggtttccgtgctcgttagcaaagtcgtaaaggctctttctgtacgactcatccacatcctgctttgtgaaatcaatgtcatacaaaagtgcctgtatataaaagccggtgccgccgacaactatcggtatctttcctgcttcgtatatctcattaagtgcttttttggccatatccttaaagataaatacattgaactcgtcagatggctcaagctcatctatcagatagtgctttatgccgtccatctcatcgactgtaaccttcgcagatcctatatccatgtatttgtatacctgcatggaatccgcggatattatagcaccatttattttttttgcaagctcaatcgatagagctgtctttcctactgctgtcggtcctgtcaggacaatcatcggtttttgtgtcatattgcacctcagtccaaatgtgtatgttgtcatacgatacgtttgaatttcttttctatctcatatttgctcatagagatgatggttggtctgccgtgtgggcagttgtaaggattgtcgagtgacaaaagctcatctatcagcttatttatctcaggaagagtaagcttgtcattgcccttgactgctgccttgcacgacatggatgcaaccttttccgtgatgatatcaggagtctgcctgcctgtcgcattggaaaaatcatcgagcatctctataaacagatccttcatatctatgttaaacaaattatccggaatagcactgatcatgtattccttgccgccaaaatgctccacctcatagccaaactgttctatctgcggcctgtatttctcaagcatctcacattccctggcatcaagtgtcatgacaatcggagggcttatgcgctgtgatgtgaaatccttattggcaagtcttgccatcgttttttcatacagcaccttctcatgagctgcatgctggtctatgatataaagcttgtcctcaaactctattaaccagtaggtcttaaagagctggcctatgatggaaaactgcttctttgagctttctgtaagaaaaaccttgtcgtaatcgccgagtgtctgctgggtgccggtgacaacctgtgcaggttcatacgcggtggaagtctcaggcgcttttgcagcaggttctgttgctgagtaattttttactgttgacgtcacgctctgtccgtacacactccttgattccgctgccctcacctcattgatacgcctcttctcaaacggctccggtattggctccttatactcatgcactatctttttaggcgccggcgtactgtctacaggcacctcgggaatcatctccttgtgggatagaattgcatatattgtgtcacacaattcgacatatatctcgttgttgttgtcgaacctaagctccatcttggtcggatgcacgttgacatccagctcactgaaaaatgtaaagtaaagcactgtaaacggatactggtgctgcattagaaagctcttgtaggcctcctcgatagcgcgtgacaatatattgctctttacatacctgccgtttatgaaataattctcataatttctgttgcccctcgtgatgacaggctttcctataaagccctccaccttaaagtattcgcattcatgcttcacctcaagcagtgatgatgatatctcgcgtccgaatatatggtatatgatatcctttctgttgccgtttcctgaggtgtgaagctttgtctggttattgtttatgaacttaaacgatatatcaggatgcgaaagcgcaagcttttcaaccatatcgcttatgtagctgccctctgtctgtgctgtctttaaaaacttgcgtcttgccggaacattataaaacaaatcctttactatgaaggtagtaccgtccggagcaccgatttcctcgttggaaagctccttcgagccttcaatcacatatctggtgccggtgagctcatcgtatgtctttgtgataagctcaacgcgggcaacggccgagatgcttgacagtgcctcacctctgaagccgagtgactttactgtgagtaaatcctctgccgagcggattttgctcgtgctgtggcggtaaaatgcaactgcaacctggtctctttcaattccgcagccgttgtcggtgatacggatgaatgagattccaccatcctttatctccacagtaatggctgtggagcctgcatctatggcattttccaccagctctttaaccacggagcacggacgctcaacaacctctcctgcagctattttatctattgtttcctgatttaatatggcaatatttggcattttaatcctttctaccagcggtttttaaccttgttctggagctgatacagcttgtttaacgcatcaagtggtgtcatgttgcctatgtctatgcttcgaagctcatcaattatgtcatcatccttcactgtgtcgaaaagtgaaatctgtgtcatatcaacctcgtcaagatgctcctttttatgcttgtgaccagtgtcaacggatatgctttttacagtatctgtgatatcatttgcaacaagctgctctgcgatttccttggcacgctctatgactgaatccggcagacctgcaagctttgcaacctgtatgccgtagcttctgtcagctccaccctttacgatttttcttaggaatactatatcatcgcccttttcctttacagcgatgcaatagttatttacactgtcaagcttgccctcaagctcagtgagctcgtgataatgggttgcaaaaagcgtctttgctccgaggagctttggattacttatatgctctacaactgcccaggcgatgcttagtccgtcaaatgtactcgtgcctcgtccaatctcatcgagaatgagcagggattttgcggttgcatttcttagtatatttgccacctcgttcatctcaaccataaatgtactttgtccgcttgcaaggtcgtcagatgcaccgactcgcgtgaagatacggtctacaataccgatatttgcagtttgtgcaggtacaaagcttccaatctgtgccatgagaacgataagtgctgtctgtctcatgtaggtagatttaccggccatgtttggccctgtgatgattgagattctgtttttgtgctgatccagatatgtatcgttttctataaacatgtcatttgtaatcattttttcaactacaggatgacgtccgttttttatgtctattattccgctttcatttatctttggcttgcagtaattattctggctggcaacaagagcaagcgaagcaaaaacatcaatctgtgctatagctctggctgttttctgaatccttgaaacattgcaggaaatctgttttcttacatcacgaaacagctcatactcaagtgatgtgagcctgtcctctgctccaagaatggtatccgcaagctccttaagctccggtgtgatgtagcgctctgcattggtgagtgtctgtttcctcacgtaataatccggaaccatatccttgaaggagtttgtgacctcaaggtaatatccgaacactttgttatacttgattcttaagtttttgatgcctgttttttcacgctcaccggcttcaagctctgcaagccatgtctttcccttggtttttgcgtctcgaagacggtcaacctcctcgttgtagccagcttttatgatatctccgtcacgctgtgagataggcggctcatcctcaatggatgaaagtaaaagctcatatatatccttaagctcgtcgaactcttcattaatctcatcggtaagctcacacggtatgtctgaaagctgctgctttattggtggaagcatttttaaagaatccctgaaggcaataaggtcgcgcggattggctgactggtaggtgattcttgtgatgagacgctcaaggtcataaataggattaaggtattccctgatttcatctcttgtgatttcgtttgcattaagtgcttcgataagcttctggcgctttattatctctgccttttcgataagaggctgctcgacataggtgcgaagcagtcttgctcccatagccgtacgtgtcttatcgagtacccaaagcagtgagcctctcttttgcttttcacgaagggtatctacaagctccaaattacgtcttgatgagctgtctattatcatatatttgcctattgagtacggatgaagctcaagtatattgtcgagcgagttcatctgcgtctcataaaggtactttaacagggcgccggcagctatgactccactctcataatcctcaagccccagagcctttattgtctgtacatggaaatgtgaaagcagtgtctcatttgcaagaccatcagaaaaataccatgagtcgagtgctgaaacagtaattgacagcctgtttttcatatcgtcaacatctattccgctcatgtagaaggcctcgttgcatatgatttccgatggattaaatctgctcacctcatctaacagctttctttccgtatccacctctgtcgtaaaaaaatcacctgttgtgacatcacaggttgctatgccgtatttgtcttcagtgtatacaatcgacattatgtaattgttttttgcctcatctaaagaagccatatcagtgtttgtgccaggtgtcacaacacggattacctctcgctttacgattccctttgcctgctttggatcctccatctgttcacagatagctaccttgtgaccgtttgatacgagtctgttgatatatgagtctgccgcgtgaaacggtactccacacataggagctctttcttcaagtccgcagtttttgccagtgagcgtaagctcaagctcctttgaaaccattatcgcatcgtcaaaaaacatctcatagaagtctcctaagcgataaaataaaatacaatccttatattgttcttttgtctgcagataatgctgcatcattggtgatacttctgccacgaatatttcctctctttacgtgtataaatattattcatgtgtataaatattatttaaaatccggcctatattttttaataattgcttctgcgacctttatgccgtcgattgccgcagatgtaatgcctcctgcatagcctgcgccctctccgcaagggtatacacccgagatgttgctctcaaaggattcatctctttttatgcgaagcggagaagatgtgcgtgtctccataccggacaaaattgcatcttttctgtcaaagccatgtatcatatgaccaaaatgttccattccaagcttgaatgactgctccatgtcagcattcatcagtccgttcagctttgcaaagactgtgcttccctttgtacaggagctaaaatcaccgtatgctgttgttaatctgtcatcacagaaatcaccgaaaagctgctgtggtattaaaccattgcctcgcttataattttctgtttcaagcttttcctgatatctcactccggcgagggcatcatctgctccgaaatccttcggcgaaacagatactatgatggcactgttcgcatttttgctgtttctgtcgtgatagctcatgccgttaaccaccgtgtgattttcggttgacgatgagttgaccacatatcctcccggacacatgcagaatgaatagactcctctgccattcggaaaattggatgtgaccttgtatgggcttggcggaagtatgattttcttttgaataccgtactgtgattcatctatcatgcgctgcggatgctccacgcggaagccgactgcaaagctcttgcactccatatcaaagcctttgttgtaaagcatatcaaatgtatctctggcgctgtgtccgagtgccagaacgcatacatctgtctttatctcactattactgttactgtcagaatccgtgtaaacacttaatagcttttgggaaactatgtcaagattgtttacacaggtgtcaaatacaaatgtagcacctttgtcaaccaaaaactcacgcatattgacaattacttctgaaagtacatcagtaccaatatgtggcttgttgtcataaagtatggacggatctgccccaaatcgcacaaatgtctcaagcacaagacgatttctgcccgaaggatcctttacggatgtattcagcttgccgtctgaaaaggttccggcaccgccctcaccaaactgtacattgcttttgggattaagtatgccgctatcccagaatttttgtacatcgcaggttcttttctcaacccggctgccacgctcgataactatcgggcgaaaacctgcctctgccagtatatatgcacaaaacaagccggcaggtcctgcccctgcaataacaggtcgcctgtcaagcggtatatggccgcatgcaggtatcatgtactctttttctttatatatgagcacagatgagctggctgctctttttacaattgcttcttcgctattttttgtatcctctatctctacagcaactgaatatgtatagaacagctcaggctttttacgcgcgtcaagtgatttctttaatatccggtatgtaaagcctgtcttggcattgagcttaagcatttttattattttcttttttaatgcctcatcactgtgtgtgacggggagctttatctggttaattttaatcatttactgcatttctcctgctatatatccacttgtccatgcccactgcagattgtagccaccgcatatgccgtccacatcaagcagctcgccgcaaaagtaaagccccggatggattttggactccaatgtacgtacatctatttcctttgtatatatgccgcctgcacacacctgtgcaaattcggctcctcttggcttttttaccgaaacggctgtatgctttattgagcgggtgagacttttacaatcatcatctgtcaacagccttccctttttgtcaggagatacacctgatttgtgtatcagctcaagaagaagcttattgtttaaaagtccgttaagcatctcatttaacgagcggttgtctgtcgttgtaatgcttctgtcctttatgtacccattaagctcatcatcactaaaagccggcaaaaagtcaattatcacctcgaccctttgacctttatcgagggctcttgacataagacttgaaatctgaaaaaccgggatgcctgagatgccatagtcggctaactgcagctcccctgtattttgctctgtcatttgaccgtctatcacggaagagacagtggcatcgcacctgacacctgtgatttttttgaaattaagaccatcacagctaaagccgcaaagcgcgggtaatggcttttggatatgatgtccgagagcttctatctgtcgaaacaggcttccgtcacttccaagcttcggggaagccgtaaggccacacgctatgataagccttttggacttaaagctgcccttgtctgtttggatgcagtaaccggtccggtcatctgccttcttattagttgccggattagcagcagactttgtgtctttagtcataatccttgcagtcttgatttctgtaatacttatgcctgttttcacatccacatgaagcctcataagctccattcgaaaggctgccacaacagatgctgcctgtcttgaatttggataaatgtagctaccattgtcatatgcaggtattccaagttctttaaaaaaacgtattgtgtctgcataattaaattgcgacaacccgtttttaatcagcgccttactgccgtgaaacttatttacagacatatcagtgtttgtgaaattacatctgccgtttcctgttgcaagtattttctttcctatatcatccttgtgctctaaaagtgccacacgtgctccctttgatgcagcagctgctgccgccatcagcccggatgcaccggcacctattataattacatcgtacatattctttcccctaactgatttattttaacattaacttgaatagctttcaagaaaatcgtacaaatcagtttcgttaaaaaagtagagtccgtttgtaaccttattttttgcttcatcgggcagttcttcaaaatacacgcctgtgtcaaagtatttttcacttgcagtggcgttgtatacagacagcattccgaagtcatttttgatgcagtattttgcattcttagcctcatttgatgtcagaaggctttctttttcatttttttcttttttatcattttcattgctttgtgcaattatcgcagccttgtctgcagctatttgcgtattgattttttctatcataacaagtgcaagaagaattacaacaatagttaaaaaacagatactgattttgcttttcatattatcacctcaaaatcagtatctgtaaatttttgttatttattcaattttataataaatgacatttttttgccacttttatgataagtgtgccctttggaaaatgtctaagctcatcctcagtcagtcccttgagtaaaagcagcgccacagcatatgagataaccgcaatgattgcagcaagaatgaaggcgataatctcaatatgacaggccttgtaaagtataaagtatactatatacgaaataactcccattatgagcgagcttatggccggtatgataaaggtcttttttatttcctgcttaaagccactgtacttctttaaagccatgctgttcataaagcacatgagcaatgcaaaaaacgtattggcaagcacaactgcatgtatattgagcctgaatatgagcataagaagtatgagtactatgacatgcgctacaatcgatatcgcagcgttgattacaggaactttgagcctgtcaattccctgcagtagtccgttggacagagttgaaagcgagtaaaatactaccgcaaccgcaccgacatacatcataagtgatgcctcagcatttgttacacgggtgcttgagaacagtatattaaatattggcagtccaaacacggcaagccctactgcacatgggaatgcgacaaccatgataaagcgtgtggaaagattaatctgtcctctcactgcctccatatcgtccctgtgatatgcgcctgtaagcaccggcacaaaggatgctgccatagctgatgctatggatataggcacattgattaaaagcttgtactttccggtgtatacaccccaccatacgtctatatcattctgagtgtatccctgaagcagtgcaacctgcttgaatataccctggtctatgatgccactgatattgtatatagtagtacttaaaagcaccggaataaccgtaattacaagaatcttcatggtgtagccaaatgagctcaccctgacatttcgttctcttttcatctgtctcttgaacaccttcatatagatggcaaagataaatactacaaataaaagagccgctacagagccaagcactgttccaagtgtaccaccggctgcaccatatgctgcggcatagtgctccttatcaccaagtactgcaccaattcttgtacctgtacggtatagcacatatgcagcccatacactgactatggcatttactatctgctctattatctgtgatacggcacttggcatcatagtacccagtccctggaaaaagcctctgatgacgccgagcactgcaactaccaaaagccccggagccagtactcttaaagcaaaaatactgtatggtgtgttaagaagcgttgtcgcaaaaaaattgccaccaaaaaacagtatgagtgcaaccgttgttccactgatggttgcaaaaagcagagcgcacttcagtatctgatacgttgcagtccgcctcttttttgccatctgggctgaaaccatctttgatacggcaagtggtaagctgtatgatgatataatcagcatgacattatatatttcaaaggctgtggaataatagccgattccgatatcgcccaatatacgctgcatcggtatacgatatatgagtcctattattctgcttatgatagatgctacggcaagtatagagccctgtactaaggcattacttgccccattgttttttttagacatttataaaatcctctgtttcaattgataaccagcttaaatattagcgtgttatacctaaagcgtcaagtatttttctctggtgctcttccattacggcagcctcgtcagcctccatgtggtcatatccgaacagatgaagcatgctgtgtgtaatcagaaaggcaaattctcttttttcgctgtgtccgtattctaatgcctgctcctttactttgtcgacggatatgattatgtcgcctagcatgacctctcctgtatcaggattgaaatcatcctcattctcatctgaaaggaaagaaaaatctccgggtgtttcatatgaaagcatcggaaaagataatacatctgtaggcctgtctatctgtctgtactccttattgatggcatgtatcccttcattgtctgtcagtgtcaaattaacctccgcctcatacggaaagctctcatgctcaagtgaagcagaaacaacagcttctgcgaccttttcataatcaaaattaaaattgcattctacttctttttcgataaaaaaactcatttaagcagctcctcctttgtaagatagtctcgtatttttaaaaagtgattcatggaaagccctgattcatcatacattcctgagcttgacagctcatttaatgtctggataataagtatctcgtgattccattcactgtctgccacatcgtttttgatatgatcaagccttactattaaagcatcgaccatatggatgagtgcggattcaggggtctgtggatgtcttagcttgccatagtactcatagagtatattggtcagcttttcaggaaaatgcatggctaatgcctgttccactccttccatgacgcttttatgcttctgccactgccctatgcggtaataaaagcctcctgctgcacatagcgctgtatccagtcctgcagcctttgcagcctttatggcaatcgtcgatacgaaattgccatgattgtattcagagaaattgtgctttttaagctgctttacagcaggaaaatcctcctctattattgctataagcctgtcatttgtttcatcagcgctaagtggcttaaataccctggcacaaatgatgccgataagcgaaacaatcatgccgcttacagctccggcaataataacggaaacagaaaactcctttgttgacatataatagaatatgcccggtgtcacaatgctcatactgattatgatcagatatatacatatctgaagcttgtcctcctttagcatctttgcaaggatagcacctgtgattacaagaagcagctcacatacgagctcaaagcagtcgccggatacagtgattgaaagcaatatacaaaaataagtaccgcttataaatgccagaaactcattgccaatcagacaaagcaatataggaaaaatcatcaccggcctgctgtacagtggcataaaaccgcttatgatacacactacagagcaaatgataaacgcaaacgtaaacctaagataatcagttcttgagttgttcgacagctgcagtgtgttccgctcgtactcaagctcaaataaaagcagcatataaaatatgatatctaaaaaacccatgcatatccactcatccggatatacatcaccaagcagacacagcacaaatgaaagagctaagattgatataaaaattgatattagtgatacaacccttctcaattgctcttcctctgctttcttgcagtctttgcagtctgcttattttcataatcatcatatgcctgaacgattttttgtacaagcggatgacgcacgacatccttgcttgtcagattgcatatgcctatatcatctatttttttaagcaccctaagtgccacatcaagccctgattttgctcccggtgcaagatccttttgtgtcgcatcacctgtcacgacaacttttgagccaaagccgattcgtgtaagaaacatcttcatctgtgcaggagttgtattctgtgcctcatcaagtatgataaatgcattgtcaagtgtacggcctctcatgtacgcaagaggagccacctcaataaggcccttttccatgttgcgctgaaagctctcagctcccattatctgataaagagcatcatacaacggtctcaaatatgggtcaatcttgctctgcagatctcccggcagaaagccaagcttctcgcctgcttcaatcgcaggacgtgtcagaataatacggcccacctgctcatttttaaaagctgttatagccattgccatggcaagataggtctttcctgttccggcaggacccatgccaaacacaatcatctttttcctgattgcatcgacatattccttctggcctatggtttttggctttacaggcttgccatttattgtgtgacaaatgatatccttgtcaatctcaacaatctcactgcctctatgctcctctaaaagtgcaagtgcatagtttacgttctgctctgtaatgatgttgcctctctcagccagcgcaatgagctgctcgaacacctcttttgccccatcaatattcccctgcgctccgataatctttaaggaatcatctcttaagacaagtgttacgtgcagtgtgcgctctattttcttggcgaatgcatcaaactgtccaaagacgtttggaatatattcgcccggtatttttatagatacttcatttaaactcattagctcatgtgcctttcaatcaaaatatttttcattataacataaaaataaaatttgtcataatttacctataattaattccctctgatatatcaattttcatggtatttttttctatgtatatactgcaccacgtgatatcgggatatttttcctcaagcttcttttcaaggaggctgtaatctgctctcttgtggctgcctattgttacattttcactctcaataaaggagatgaccgactcatcatacgtgaaacggtttccttcaggcacaatgtgccagattcttgtgcagatgagtgcatgtatacaaaaaacgccggtaattgcagccgtaataatacgtattttatatagaaatgctcttattgcaaagtatccctgtctttttaccacgagaagccttgtatgcgtctttttcaggtgcggcttcattagaaaaatatcttctgtactgcagcaggcctcatattcctttggacttacatatttaaggttccatatttttatatggtttgccgtgcacagatttatgaagcgcctgatattgcagcctgttagccttactgttgcataagctttaatactcatatataacaccctttaaatgaccggctattattattaaatcctttgtaaattccttgatttcaaggcggctgccggatatttttatggtactgtctgctgcccttacagttacggccttgtccgaaaatgacagaatacccttgtggttttctatagtcaactcattataaccatatgctgttacaattggaagccctagcactatgtcctttggaagctcgaacgaatcagttactttttgcatcttcatatattaacatatgtttatttaggctgaattatgccggttatttgtggtacggctcattattgctgatgcgaaacgacctgtaaatctgctccagtaaaattacgcgcatgagctgatgggggaatgtcattttagaaaatgaaagcttatagtcagcgcgcttcaatacatcatcggacaacccgagagagcctcctattacaaaaacaagatgacttttgcctcctgtcataagcttatccatcttctgtgacagctcaaccgaatcaagctgttttccatctatcgccagacaaaatacatatgcatcgtcttttatatttttaagaagcctctcaccttctttattttttacgatgtctatctctgtctgtgtggcctgttcgcttgtcttttcatcggaaacctcagtgatttcaagcttacagtaacggcttaggcgctttgagtactcagcaatcgcatctctgtaaaatttttctttaacttttcctacacataatattgtaattttcatcgtttcattataacatataactataattaaacaatatggaggccgtatgaaaatatacgttgatgaacaaaaacgatacgatgatacaaaagcaaccggacagtgcttcaccggagtcggtgcgatagggcttattgctattgtgctgcttgatacaggagttataaagcttgccgctttagactcggtaaacaagcttatggtttctatcgtaatggggcttgttttcttgatattttttatcataggaatgaagtcatttatggagctaaaggacatttcaaaaaaaattgaccggaataattccctcgaagaggaaatcatggaatacgtgaccgtcactcatagggacgagcttatgactttagcgtcatctggtgaaaaaggagatgcctgctcaggtgatttatactacaaaagagctgagcttatcacatcagtcattactgaaaaatacagcctgcttgaggaaagcttcctcgatcatatggttgaagaaatttattctaaaatttatagtgatattgtcgaagaatagtgctataataataacaatttattttttatgaggtgaacaaaatgaaagaactgcaagatcgaattctcaaggatggccaggtaattggcacaaacatcttaaaggtcaacaaatttatcaaccatcaggtagatccggtgcttatggagcacatcggtgaggatttcgcaaatcactttgccgataagggaatcacaaaggttgtcacaatagagagctcaggaattgctcctgcacttatggcagcagccaagatgaatgtaccgcttgttattttaaagaagcagccttcaaagacattacataatgatttatatcagacacaggttacttcatttacaacagagaagagctatgagcttacactctcacgcgatgttatctcagaggatgacaatattcttttgattgatgatttcatggctgacggagaggctgctacaggtgccatcagacttcttcgcatggctcacgctacagttgccggtataggaatccttattgagaagtcattccagcctggcagaagaaagatcaacgagcagggctatgaggtttactcacttgcacgtatcaagtacatggatgaatatcagatagattttatcgaagaaaattaaaataagatttaatatttaaaatcaatacatattatacgaaaaatccactaccctatttacagatttatgagtctgtcaatgggtagtggatttttattattgttaaagtatatgttttatgccaaactgccggattatgctccgaaatcgaaaagtgaaagctggtttgactccggcagtgaaccaagcagtcccaaatctgacatgaggtctacggctgttcgcgatacatgagttctctccctgaaatcgtcctttgagaggaatggtccgtcctttgccgcttccgaaatataaatagcggcattgtcgcccagtccgtcaatactgtttatggccggcatgagcttaccgtcaattatctggaaacggttagggtgagccctgtatatatcaagaggcatgaaatcaaagcctctggcatacatctcctgtacgatacgcatgtccttaaatacatcctgctccttgtttgacagcgtgtcttttcttttcttatagtccttcatgtagttttcgagtcggtcctttccctgacacataagctcatatgaaaagcctgtagcacggattgaaaagtatgctgcgtagtatgcaagcggatagaaaaccttacagtaggcgattctccatgccatcataacgtatgccgcagcatgggccttagggaacatgtacttgattttctcgcatgaccagatataccagtcaggcacaccatgtgccttcatatcctccttccactgtggccactgagggcatttgcccttggcaataatgccctttcgcaccttctccatgatgttgaaggcctcctcagattcaagtcccatggaaatcagatatgtcataatatcatctctggtacagatacaggttgaaatggtagctgtgccttcctcgataagagtctgtgcattgccaagccatacgtcggtaccgtgtgataatccggcgatacgaatgaggtcagaaaactcctttggctttgtatcaaggagcatgcccatggcaaaatcggtaccaaactccggtatacctaaagctccaagcggacatccatcgatatcctcaggctctatgcccaaagcggaggtgttctgaaacagtgacatgacagctttgtcgtcaagcggaatctttgtcgggtcaacacctgtcagatcctgcagcatacgaatcatggtaggatcatcgtgtccaagtatatcgagctttaacaggttgtggtcgattgaatggtagtcaaaatgcgttgtcgtgatgtcaacggtcatatcattcgcaggatgctgtacaggagtaaaggtattaatctcctcacccatcggcagcacgactataccacccggatgctgtcccgtagtacgtcgaacaccaacgcagccctgcactatcctgtctatctcgcagtttcgctttctgacaccgcgctcctcataatagtttttaatgtatccaaatgcggtcttgtcagcaagtgtacctatggttccggctttaaaggtctggccctcaccgaaaataacctcggtatatttgtgtgcctttgactggtactcaccggagaagttcagatcgatatccggctccttgtttcccttgaaaccgaggaaggtctcaaatggaatatcaaagccctccttgcttaacggtctgccgcactttggacagagcttatccggcatatcacagccaccacggcctgaaaatgcctgtacctctggtgaatcaaaatcactgtatttgcagtgagtacacaaatagtgagcatgcagcggattaacctctgtgatacctgacatggttgcgacaaatgagcttcctacggagcctcgtgagccaaccaggtagccgtcctcatttgatttccacacaagcttctgtgcgatgatgtacattacggcatagccgtttgaaataatagagttaagttctctgtcaagacgctccttaactatcggcggcagcggatctccgtacatcctgtttgccttgttatagcagatttcacgaagcatgccgtcagagttttcgataaccggcggacatttatcaggtctgaccggtgagatacgctcacacatgtctgctatcttattggtattggtgatgactacctcctcagcctttttgcttccgagatattcaaactcctttagcatttcctctgtggtccttaagtaaagcggagcctgctcatctgcatccttaaagcccttaccggccatgataatacgacggtatatctcgtcctcggggtttaagaaatgtacgtcacaggttgcaacaaccagctttccaaattcctctccaagctttacgattcgcttatttatatcgataaggtcatcgtttgaagcaatatcggaatcctcgtcacgtatcataaatgcgttgttgccaagaggctgtatctccaggtaatcatagaaattcacaagtcttgtgatttcctcctgtggtcttccgtttaaaatggccctgtaaagctctcctgcctcacaggctgagcctattaaaagcccatcacgatacttgttaaactctgattttggtattctcggtctcttattataatacttgatgtgtgacagtgagataagtctgtagagattggtacgcccctggtcacaggttgcaagaatgatggcatggtatgtaggcatcttccttatcatctcaacagatgattttgccagggcatttacctcatctaagcttgatatgcccctgtcctttagcttttctatgaatttgacaaatatctctgcggtacatgcggcatcatccaccgctctgtgatgatgatcaagcgagatgtttagagccttggctactgtatccagcttaaatctgtttagctgtggcagaagcactctcgcaagagccaccgtgtcaacaattgtaggattatactccatgccaagcaatgcgcagtttcgctttataaagctcatatcaaagtcagcgttgtgggcgaccatgatgcagtccttgcaaaactccataaactgtggcagtatgacatccactgttggcgatgtgataaccatgtcatcccttatcgaggtgagctcctcaatcctgaacggaataggtacctcagggtttataaatgtggaatagcggtctacaatctcgccaccgatgaccttcaccgcacctatttctatgattttattcttttccggagaaaagcctgttgtctctatatcaaataccacgtacttgtcatccagcgactgaccggctgcattctccacaatatcctttgtatcatcgaccagatatgcttccacaccgtaaatgaccttgaatttgtcatccacagtatggttagcgtcagggaatgcctgcacatcaccgtggtccgtaatagcaatggccttgtgtccccagcgcattgcacacttcacaatatcctttacgtcagacacgccatccatgtcactcatcttggtgtgacagtgaagctcaacacgtttttcagcagcagtatcctccctctttgatgtaaaatcaggtatctttttaagtccgactattgagcttattgacaaatcactgtcatatttatctacagtcacaactccctttgccttaacaaagttgcccggggcaatatatgcaagaatatctgctacgtcatcatttctggcaaaaagcttgagcatgatagtgtctgtgaaatcagtgaccgcaaacataatgatggtcttttcgtttctgatttcgcgggattcaaccgtaagaatcttgccctttattgtaacctcaccgataggaccgtcaatcttttcaatagccatctcctcatcatcaaagcttcttccgtacacgatatcagggtcattgtcatatttgcgcctgaaatctcccttgcgctcgaacttcttctcaaatttcttttcaaatttcttctcaggctttttatcagtgcctgtctttgcttcattcttcttatctgaggctttaggaaaatctgatgtgccactcttttttgtatcagatgtattttcactgcctcctacgaacattgcaccgtcatcgacaaccaccttagcttcttcatcaccgtcatcctttgccatggcaaatttagtgcgggcgacaatattttgcacctcctgctcaatctgcttgtcagcattctgacggtatttgctgatttttggtttttcgtactgcagattaacgataaaatccatcccacagcgctcgcagaacaccttctcaagaaattctatgaccgaattgcctctggtctttgcgattattgtctcctcaagtgtgactgtgacatgtgtatcgtcggtaaagctccactttgaggttcgcagcagattgtacaaaagtacactgtgactgtttatttcgtcaagaatactgtcaaaatagacatcaaaaagagtcttcggtgtgtactgcgaagacaactcgtaagactctataatttttactgtaatatctttacttttaaatatctgtttttttatgctttcttctagcttccagatattttttttgaaaataaggcgttttgcttttacatatattttgtaaaaatctcttgcatggtttacggaaattctggtgacatcagcattctccagcagattctccatatccttgtccagcttaagtgtagggaaaacttccttaaatgtctttgtcaaaattattcaccccaatggtcaagctcatatttcaatgcacccaaaagctcgctctcaggcacctttttaaatacctcaccgtgttttatgataagaccctcgccgattcctccggccacgccaagatctgcttcctttgcttcacccggtccgtttaccacacagcccatgacagcaacctttatgtcaaggtcatatcctgaaaccattgtctccacctgatttgcaagcccgataagatctatctgtgtgcggccgcaggtaggacatgaaacaacctctatgccaccctttctaagacccagagttcttaaaatgagcttggcagactttatttcctcgagagggcttccagtgagagacacacgtattgtatcacctatgccctggcttagtatcagtccgagtccgatagcagactttatattgccgcttattattgtgcctgcctctgtgatacccacatggagcggatgattggttttatctgaaataagctcatgtgctttaacacacatcatgacatctgatgatttgatgcttatgacaagattgtcataccccatatcctctatgagctttaccttgtccaaagcgctctccacaagtccctctgctgtcacaccatgatatttctctaccaggtctttttcaagagagccactgtttacaccgacgcggatagggatatttctctcctttgctacatccacgacagcctttaccctttctgcgcttcctatgttgccgggattgattcggattttgtcggctccgttttcaatcgcagctattgcaagcttgtaatcaaagtgtatatccgcaacaagcggtatgctgatttgtttcttaatctccttaagtgcccttgcagcctccatcgtaggcacagcacatcggattatatcacagcctaagtctgtcagcgcgtttatctgcgcaactgtgtcagctacattctcagtctttgtattagtcattgactgtatgagaatcgggtttcctccaccgattactttatttccgatttttactatttttgtctccatgtgtatatctccaatctgttataaaatcagactattagatttctgatatcattgaacatgacaacaaccatcagaagaagtaaaagcactatgccaacgagatgcacatagccctccttctcagggtccactctctttcttcttatggcttcaactatcaaaaatacaagtctgccaccatcaagtgccggcagtggcagcaggttcatcacaccgaggtttgcagaaatcagcacgccccagtttagcatatttagtatgccaagccatactccggacatagaaactgcctgctcataggtatctcccatgttctttacaatgcctacgggtccgcttaagttatttacagatgcagcccctgtacagagcattttaagcccctctattgttgtatagatgttgtatttcacctcgtagcagctataaagcagcgcctttccaaagccgggctttgtacgctctcccgacacgttaaagccgtacagatacctctttgttgtctcgtcatatttaggcttcaatgtggtggtgtgccttttgccatccctaaggtaggtcacatcaactgtttcaccttcgtgaagcatcgagtagaggcttatctcgcggtaaaagtgtatattcgtattgttcagctttacaatctcatcaccggccttgataccggcctcctcagccgcatacccctcaataacaccggcaagctttggactgtcatagcctacagagcagatgataatgagagcaaaaataaatgccatgataaaattaaaaaacggccctgcaaaaacaacgcttatgcgcgcccacactgatttgttgttgaatgccctgtcatcacctgagttttcatcctcaccctccatgatacaggctccgccaaatggaagcagctttatggagtatttggtctctccacgctgcactccaaaaagagtcggtccaagtcccagacaaaattcattgacctttatgccatttgctttagcaagccagaaatgtccgagctcgtgaaaaattactatgatgctgaataatatgattgcaataataatactaataatgttcaaaattaccaccttttactgatatagtcatatgcgcactgctctgtatcaagtatctcatccactgaaggattttcaataaatgatgcattctccatacatgcctcgattatatcgattatttccagatatttaatctttttattcaaaaacagtgccaccgctctctcgtttgcagcattgaaggccgtaggaatattgcctcctgcccttgcagccttcatggcgagagcaagccctttaaaggtatcaagatccggtgcctcaaaggtcagatccttaagcttaaagagatcaagcctgtcaccggaaagcgcaggtctgcttggataatacagtgcatactgtataggtatacgcatatcaggagtaccaagctgtgctataactgctccatccgcatactcaacagccgagtgaatgacactctgaggatgcactacaacctgaatctgcgacaaatcgacatcaaaaagccattttgcttcaatcacctcaagccccttattgaccatggttgatgaatcaatagtgattttttgacccattgaccagttaggatgctttagtgcgtcctccacccttataccttcaagctcagagagctttctgcctctgaacggacctccggatgctgtcagaagaatctttttaatcggattcatagaatttccctgcagtgactggaagatggcactgtgctcactgtccaccggaagaatggacacaccatactctttcgcaagcgggataatgatatggcccgctgtaacgagggtctccttatttgcgagtgcgatggtcttttttgccttgatggcggcaattgtaggacgaatgccaagcataccgacaattgcagttacaactatatcgcaaggctcaatggtggcacatctaatgagaccgtccatgccatagcctacttcgatatcagtatccgcaaggcttgtgcgaagctttttggcatcgttttcatcacttacactgacaaactgtggcttaaattcccttgcctgtttctctataagggagagatttctgccacaggaaagtgccacaacctgcatatcaccatgctctcttatcacatcaagtgtttgtgttccgatagagccggttgaaccaagtattgatatttttttcatgataattcctcgatttatatttttctcagtggttctgaatagttaccttagctttttgttttcaatggttcttaaatgttactttttaacttaaaaagaagctagccagataataaatgattggtgctgtgataatcatgctgtcaaagcggtctaaaataccaccatgtccgggtatcagatgtccgtaatccttgatatcataattacgctttatggctgatgcgcacaaatctccaaccattgaaataaggcctgcaacagcagctataacagcaagtatagcaatctctgtgccgtctatattcatatgatttctgaatataaagcagtataatgctgtaagaagcgcactgccgagtacaccacctactgcaccctctatagacttctttggtgaaagctttggtgccattttgtgctttccaatcagcactccgacgcagtaggcacatgtatcacagccccaagagcataaaaataccaagaaggcaaggtaaagtccgttgttgagtgtacgtatctggtagacatatgaaagcattgttcctacataaaacataccaaaaaaggctgccatgagctgctttgcatcatatttcgggtatgacagcacatacacgaacatcagtacaataagaaagcccatgaaaagcatcattacatcaggtatgaagctccaccttaagttgatgtaaaataaaatcaaagcaatatacggtacaaccgataagagcgatttttcaaatttaaacaccctgaaaagctcaaacatacctatacacgaaatcagaagtgttgaaaaaagaagcacctcgtttcctgttactataagaaatatagcggcaattacaagaactataccactaagcagtcttgtcttaaacattatttatcctccgtgtcgttcgtttcttttaatccaccaaagcgacggtctcttttattatatgcatctatagcctttttgagttcatttttatcaaatgcaggccacggaacatctgtaaaataaaactcagcgtatgcaagctgccagagcaggtagtttgacaggcgctgctcaccacttgtgcggatgagtaaatcaggatccggaagctctcttgtgtcaagatatgatgagaaggtatctgcatctatatcgtcagctgaaagctttccatcatcatggtcagctatcatatgctttacagcacgtatcatctcatctcggcttccgtaattaattgcaattgtcaggttaagacctgtatttactgatgaaacttcttcaaggtttcttattttctcctggaaattctctgaaagcctgcttatctcacctattacgcgcacacgcatattgtttttattggcagtctttatacagtttttaagatagctttcaagaagcttcattagtgcagcgacttcagactcagggcggttccagttttcagtggaaaaggcataaagtgtcagatatttaacgccgaggtcgtttgcagccttacatatattctcaacatttttggctcctactgtatgaccgtagtttcttggcatacccttacttttggcccagcgaccgtttccgtccagaatgattgctatatgttccggagtactcatattttatttcctttcatttatgcatattatatatttacaatcatgacgcatcatttatttgctggtcacacagttaagtgtgaacagtaaaaccgggaataagcaaataagggacacgaataacatgtcccttgtttgtatacgtgatataaatactatacagtaagtatctctttacattttgcatcaaccgcagcgtcaacctttgcgacaaacttgtcggtaagcttttgagcgtcatcctcgaggcctttaatctcatcctctgaaatgccttcctctttgccgttcttcttgatgctgtcgattgcatcccttctgatattgcggacagcaaccttagcttcctcgccctttttcttgatgtcctttgcaagatctttacgtctctcctctgtgagctcagggaaaacaagtctgataagctttccgtcgtttgtaggattaattcctatgtcagagcagtttattgctttctcaatctccttaaccatagaagcctcccatggctgaatctgaatcattctaggctctggaacacttacattggctacactctgaattggtgaaggtgtgccgtaataatctacacgaagcttgtcaagaatatgtggattggctcttcctgcacggatgcctacatactcttcctcgagattatttaatgttttttccattttatcctggaaagggtttaatcttgaatccatattatcctcctgatatgcattatatgcaatttactatacagtaacctttgtaccgttaaatttgcctgtaagagcatttacaatgctgttttcctcattgagtccgaatacatacataggcatcttgttctcaaggcacatgatagacgctgtgaggtcaactactgcgagcttcttctcaacaacctcttcaattgaaagctcatcatacttctttgcagcaggattggtctttggatcactgtcatatactccgtcaattgctttggcaaggtaaataccatctgcctcaatctcaattgcacgaagcaccgtggctgtatctgttgagaaataaggatggcctgtaccacctgcaaagaaaacaaccatatcatgtgcgaaatacttgtttgctctgtccttagagaaaagctttgtcatgttgccgcactcaaacggagtaagaacagctgtcttcattccgacatatctgaaaatctcagatacataaatgcagttcataactgtagcaagcataccaatctggtcagcctttgtgcggtcgatggtctcactcgttctgcctctccagaagtttccaccaccgataacaatacctacctgtgtaccattatcaacaatctgtttaacctgttttgcaacctcaatgactgtagcctcatcaaagccgtggtgcttatcacctgcaagtgcttcaccacttaattttagtaatattctactcatatttatttaccctcgaaaagtccctgaacatcgatatcagcgtatgtctgagaacagaagccctcgataacggcaccattgttaatctgtactgaacgtgacttgatattacccatgataactgcagaagtatctactacaacaggtccctgaacatcaatatcgccctttacagctcctgcgataactgctgaagatgctgagatattgccgatgataacagatcctgcacctatctttacagttcctgttgaaacaatttcaccctcaaccttagctacatcagcgaaaaactctgatgaatttgtgttgccgttgactgttcctgtaacaacaatcttgccgttacacattacatttccgttgatggttccctgaatatcaaatgatcctgatgactgtaaatctcctgtgagtacagtacttgctgtgatgactgatgtttcgtcctgtacatctcctgataaaacgttattgtttactggctgtgtatttactggctgtggtatatcattcatttgtggtatctgctcctctttttgtgtattgattgtatgctctgcaaaattttcacttggagttggtcttggtacagttgtctcctgcggctgctcctcgacatgctcaagtaatccgtcgagctttgaaagctctgatgcaacgtcaacattctctcctatagtatcaactacaagattgtcagctgtctgagcctttggctctacttctttctcaggtacatctccgggtacaagctcgtttacagcctgagaaaaatcatccttaaattctttgaataatcccatgaatatttcctccatttattatcttatccaacagtatctgatttgatatattgaactttatatgtattattatcaatcggcaatatttcggcaccctgcgcttttatgctttcaacaagcggctcaatagcctctgccgtggttgatctgtttgaatcatcatgtaataacacaattgaattgtcatatttggcaatacctgaggtgacattattgacaatatcatcgacactgcaattgtcggccgtatcaccggaattgacattccagtcaaagtatgtgatatgctttgaattgagtatctttacaagctcaaccatgtctacattactaatctggttcatgctgccaccgggaaaacgataaatatccggtgctattccagtcagattggtgatataatcggaaatctgtgtcaggtcatcggtaaatgcctctgttgattcataaattttactgtatgaattactgtaggaagccatcgcaatagtgtgtccgtcctgcactatgcgcttataaacatcatcatatttaccggaggtatctgctgtgacaaagaaggtagccttgacgccacagttggcaagggcatctaaaatggcaccggtgttatcaccgggaatacaatcaaaggtaagatatacctttcttgtatccccatcatgatacacattgtcttttgactcaagctgtttcacgacagcctgagtttttgcgccagagctttcttcatcagaagcgatgtcaccatcatcagactcagtaccggtaactgtgcttgatatagctgtatttaactgaagctcaagcttgtatattctcgaattcagtttgacaaccatgatgcccagtacaactatggcaagtatagatattgctatccatattgctatagtcataataatacctgtcttaatccggctcacacgtttgcgacgctcttgctgctgtctggctaattcattatcctttgagtccatatgcgtcccccgttatgattggttttgtttcctcttactattttaccatatttttatatcttgtaaagataaaaaaattccgcaaaagtttaaaagttaaacttttgcggaacagcattcgtttaatcagtataaagatacagtttagactccagccatctgggcagcaacctcagcagcgaaatcttcctgcttcttctccataccctcacctacctcgaaacgaaccatctcggtgattgtaagatccttagaaactgactcaagatattttgcaactgactgctttccatcctctgccttaacatatgtctggtcaaggagacaaatctcttttaactgcttagatacacgaccctcaactaaaccattgaacatcttctcagccacgatagactccttgtctgccattgcaagctcaccaagctttgccttagcagcatctgataagaagttccatacatagttcatgttgttcttgtgctcgttgaagttgttgatatcatcatcgctccaaagcttctcgttaatagccttgtcaattaacttattaagaataggctttggaagtgttgtagcatcatttaatgcactgtcaacagtgatctctctaagctttgcaagctcttcatcagagatatcgtttctgctgatgtactgtgggttcatagctgcaacctgcatagcaatatttgtgattgcttctttagctgcatcatctgctgcaccatttgctgcaatgataacgccgattcttccaccaccatggatataagaagtaacaacatcacctgtaacttttgcaaatctacgaacagataacttctctccgattgtagctgtcttctctacaagaagctcgctaagtccgtttgtagcaagaagagcgtcgatatcctctccatttgcaccaccatttaagccagaagcaagtgctgtatctgctacagtctgaacaaactcctggaatgtctcgttctttgcaacgaaatctgtctcagagttaacctctgctacaactgcaacgtttccgtttacagcaacacgtgcgattccctcagcggcaattctgctctgcttcttttccatcttagctgcaccgctttttcttaatacctcaacagcggcatccatatcaccgtttgtctcagttaaagcctttttgcagtccatcatacctgcgcctgtcatttcacgcagttcttttaccatacctgctgtaatagccatttgattatcctccgatattaatgtgttttattcctcaactgtctcgtcagaagcttcctcagcagtaacctcttcctcagctccctgctttgcctcgataacagcgtctgccatcttagatacgattaatttgacagctctgatagcatcatcgtttcctgggataacataatctaactcgtcaggatcacagtttgtatcagcaatacctataagagtgattccaagtgcctgagcctctttgatacagatacgctccttcttaggatctactacaaatattgcatcaggaattctcttcatatccttgattccaccaaggttcttctcgagcttctcccactccttcttgagtgcgataacttccttcttaggaagaacatcgaatgtgccatcctctgacattgtctcgatagctttaagtcttgcaatacggctctcgattgtgcggaagtttgtaagcattccacctaaccatctctcgtttacatagtacataccgcaacgctctgcctcagtcttgattgcatcctgagcctgcttctttgtacctacgaaaaggattgtaccaccctgagcagcgatatcagatacggcatcatatgcctcatcaacctttcctacagacttctgtaagtcgatgatgtagataccattacgctctgtgtagatgtaaggagccattttagggttccatcttcttgtctgatgtccaaaatgaacacctgcctcgagtaactgtttcattgaaattacgctcattttatttacctccgtttggttattaatcttccgtgtgtttccaattagatcagccaccggtaagcgttatccggcaccggcgatcatccgcacacgtgctttatagtatttaagcctttggaattataacataccaaaggcttatatgcaagtaaaaaaatttatttctgtgtcagaatagtgattatatcatcatactattgtattattttgtcgacagacgtactatatattatatatgccgaaaacataaaaaagacctatgttctttcaaacataagtccttaaaaatatatttaaatttatttacttgtttttatttcggattctgtcaagctcatcaaagactacatcgtttactactttgatatatgtgcccttcatgccggatgagcgtgattcgataacgcccgcactctcaaacttgcgaagggcatttacgattaccgagcgggtaatgcctactctgtcggctattctgctggcaacaagtataccctcattgccgtcaagctcatcaaagatgtgaagaatagcctcaagttcagaataagaaagtgtattgatagctgaacggacaatcgatacctttctcttttcctcttcattctcctcattcacggatctcatcatctcaagccccaccactgttgtgccatactctgtaagaatgatatcgtcaatgtcatactctctgtcacttctgtactcaaaaagagttccaagcctctcgccggctatatcaataggtgtgataatagccttgtacatccttgtatcttcaccaaagccaagcgtctcaaggtttacattctcctttgttgaaaggatgccaagaagtctttcattgagctcagtgtcaatatatcctccaacctcatctactatcagttcatgaagctcatccacacctttgcagatactagagccaagcaccttgccctttttgctgattacaagtatgtctgagtcgagcaccccagtgagcacctgacatatatcattgaacacaacctttgatgaattgttgttgtgaagaagcttattaatcttacgtgtcttatctaataattgtactcccattaattgttattcctctctttcgggctttttatctgttacgtagccgcactgctcatctgcgcaggcaatcttgtttccctttacaatcatatatcctccacaacgagggcatttttctgcaacaggtctgccccagctcataaaatcacactctgggttgtcaatacagccatagtattttcttcccttccttgttttcttgagtacaacatccttaccgcatttagggcaattgacgccgattttttcaagataaggcatagtgaatctgcagtcagggaatcccggacatgccaaaaacttgccgtgaggcccgtattttataaccagattgcgtccgcactcagggcagatttcatctgtcacctcatcatgtattgtaaccttctcaagctcattttcagccttgtcgattgcctctttaagatcaggataaaagttctcaacaactgtcttccagttaacctttccctcggctaccgcatctaaaagcgactccatattggctgtaaaatgctcatcgacaatagttggaaatgattccttcataatagaatttacaacctctcctatctctgtcacatagagatttttactctccttagtgatatagcgtctggcaagtattgtagatattgttggagaataggtactcggacgtcctattccaagctcttcaagcgtctttaccaaagaagcctctgtgtagtgtgccgggggctgggtaaaatgctgcttaggcaaaagctcttcaactgtaagaagcgactcttctgtcagaggatttttaagaacgggctgcttttctttctttgcatcgtctgcagcagtatatgcaagctcaaaaccatcaaataacagtcttgaggtagcaaagctgaatacatactctccgactgagagctttactgtagtagtctcatactctgattttgccatgcggcttgcagtaaaacgcttccagataagctgatatagcctgaactggtctctcgacagcgattccttaatctcagaaggcactctgtttatatcagttggcctgattgcctcatgggcatcctggatatttttgctgctcttctttgttccctcaccggtggaaagatatttgtctccatagctttttgaaataaaatcccttgccatggcctcggcctcatctgatacacgcacagaatcggtacgcaggtatgtgatgatacctaccgtaccctgtccctttatgtcaactccttcatagagctgctgggctatacgcatagtctttgatattgggaaattcagagcctttgaagcctcctgctgtaaagtactggttgtaaaaggaagcggagctttattgctgcgctggccttttttgatgctttgtactttacactccttaccctttatttcgctaagcacattatccatctcttcctttgaggaaatggctatcttgtcatcacccctgccgtatagctttgcagtaattggcttcttctcaccctccacatcaaccgtggcatcaaggctccagtactcctcagggataaaagcattgatttcatcctccctgtcacagatgatacgaagcgcaacagactgtactcttcccgcactaagccctctcttgaccttggcccaaagcagcggactgattttgtaacctacaatacggtccaaaactcgtctggcctgctgtgcatctacaagatccatatctatttttcttgggtgctttaaggattccttgacagcattcttcgtgatctcattaaagctgatacggcttacatccttgccctcaagtttaagtgcgtgaagcagatgccatgagatggcttctccctcacggtcgggatcggttgcgagatatatcttatcggctttcttagcctccttgcgaagcttagcgagtatttcaccctttccacggattgtgatatatttcggttcaaaatctccgtccacatctattccaaggctgctctttggcagatctctcacgtgaccgtttgatgccattacctcatagttttttcccaagaatttctttatagtctttacttttgcaggcgactctacgataaccagatatttagccattataaactccttatatagtaatttggaattgtctccttaacaaatcctttttgtataagattttctaacacttcaaatagttccgataattcatacggcactttttgagacaatgtcccgattgcgataggacaaaaatcgagtaaactatacaccaatgcttcttttttatcaagtaaattttttctgaaatccatctgtgtgcactctgtaaacccagtcattgtaatgtctgagacaaattcatcaatattataaataatgcctgcgccctgctttatcagactgttgcagccgtagcttaaggtgtcggtgatacgccccggaatgacatatacgtcctttccctgctccattgcaaaatcagccgtaatcagtgaaccgcttctcttttttgcctcaactataactactatatcggataacccggaaattattctgtttctcatcggaaaaaacatcttttgcgggtcggtgcccggcataagctcgctgattatgcctccggagacctttattttatcatatagaaagcggttctctttcggataacaggtgtctgctccggagccaagaactgcatatgtattcccaccagcctccagacaccccatatgggcatctctgtctattcctcttgccatgccgctgattatctgtattccctgccttgaaagtgctgctgccagtacctttgccacctcgcagccatatgcgcttctgccccgtgctccgactatagcgacactttttcttgatttgtcgggaagagcgcctatgtaaaaaagactatacggcggattatgtatatttctaagcttgtccggataagcctcatcctccattgttacaaagccgatatccttctgctgaaataatatccactccttctctacatcataggaagctcttgattcaaggattatttttctgtcatcatctgtgaaaaacaaaatatcaaaaagctcattctttggcataaaaaacagcttttctgccgttatactgtaatcatgcagaagctttttcttcgcattgcttatatctgtaaggcttgtaagccagtatttgaacttcatgatacagcacctccccagaacttctcattgatgcttctgtagcatatagcctcgttgagatgctttgtctttatgttttcacagccgtccagatcagctattgtacgcgcaaccttaagtatcttgtggtatgtgcgtgccgtcagaccaagcttgtcaaacatattttccatgtatcttttctctcgactgccgagggaacagtatttttccagcttgtcagttgatatttttgaattataagaaaagctctcacctttaaacctttccttttgaagctcgtggcagtgcataacacgctttcttatgtccgcagatgattcattggatgtagtactgtttatatcctcaaagctaagcggtgacgcctccacacatatatcaattctgtctattataggctgtgagaccttatcaaaatatctgcgcagagtcggctctgagcagcggcacctttgcatatctggataatagccgcagctgcatgggttcatcgcaccaaaaagcagaaaattagccggataagtcacgtttctgccggctcttgaaagcctgatgcagtgctcctcaagcggagccctgagcagatccagcaggccgcccttaaactcagcaagctcatccagaaacaaaacgccattgtgtgcaagcgatatctcgcccggattaattctcgttcctccgccgattaatgcggcctgggtgacggaatagtggggatttctgaatggtctgctgtcccttaaggagctgtcattgtccaaaagaccacagatgctgtatatttttgacagctcaagtctctcattttcactaagaggaggcagaatggacggcatacgttctgctatcattgttttgcctgcaccgggaggtccgacaagcagtatattgtgcataccaccagcagccacctcacatgctcttttaataaatttctgtccgttaacatcacaaaaatcggcgtatttttcatccatttgcagctcatgtgccatgccggttttctgacacgtaaatgctgcctcatcaaactgtgcaattacatcatttaaatggcttatcccaaatatttttgcaccgcagacgagtctgccttcattttcattctgctttggaataataaactttccaatgcctttgttgtactcatcaaatacaattggcagaataccgctgaccggcaaaatttcaccgtttagatttagctcacctgcaagtgtgcagccctttatgctatcagcgtcaatcacccccatagctgttaaaacagcaactgctatgggcagatcaaagcctgttccggtctttttaatatttgcaggcgatagatttactgtgatacgcttggcaggcaaaacaatgccaacgctgtgcagcgctgttttaacacgctcctttgcttctcttacctctgaggtgagatttccaaccatatcaaaaacaggcatgccggttgaaatatcaacctccacctgtatcggaatcgcactgattccatccaaaacagccgttctgactgtactgtacatatatactcctattccaattggggtaaatgcatagacaaatgcacaaaagacatggctctatgataacatatttttgccttttgtaaacacctattcgagcagttttcgtaattttttcaaaccggccttttcaattcttgaaacatatgacctcgaaatactgagcgttttagcaatctgtctctgtgtcagctctttttcaccgtcaaggccaaagcgtttcgtaataatataatattctctgtccgataaaacgcttctcatattttgccttaaaatcttaagcgactcagacacctctatatccgataccacatcagattgtccattctcaatcacatccaccagatgaatctggtttccctccttgtcagtgcctataggttcaaatatggacacatcaccccggctctttttacggcttctaaagtgcatcagaatctcattttcgatgcatctgattgcaaaggttgcaaaacgatttccgtaatcagccttgaatgatgacactgcttttatcagtcctatagtgcctatggatatgagctcctccatctcatcctctcttactgcatatttttttgtaacatgtgccacaaggcgcatattgtgtaatataagctcatccttagcttctttatcattttgagccacttttttcagacattccgtctcacgttctaaactaagcggtgataaaaatgtattcacatagcaccctgtcattatttgcttataatatattatgttcaaatctgtattttgtgatataatctttgccatgaatagaaaaatagactacaaaatcaatgaaaatgatacaggaaaaacagtagaaggctttttgaaggagcatggctacacacatcaggtgcttgtcaggctgaagcagacagaccatggtatactaagaaacggtatatggacctatacaaacgaaaggctgtgtaaggacgatttaatcacagtccaaattgtcgaaaacgaatgctctgataatatagcacctgtaaatctgcctcttgatatagcatacgaggacgatgatatcatcgtaataaacaagccgtttgatatgcctgcccatccctccgccggaaaccatgacaacacgcttgcaaatgcgctcatgtactactatggcagtcagaacaagccgtttgtatacagatgcataaacaggctggacagagataccacagggcttacaattgtcgcaaagcatgcacttgcaggcgggatacttggcaacgctgtcgcaaagcgtgccatacaccggacatactacgccgtctgcagtgggtgtacacctgcatgcatgcgcattagtgctccgattgcaagaaaggatgcttccaccatagagcggtgtgttgatttcaaacgcggtgaatatgcagtaaccgactttatcagaatcaaatataaccctgataataatttatcgcttgtcaaactaagacttcttaccggacgcactcaccagatacgcgtccatatgaagtatatcggttttccactgataggtgactttttatataatcccgactatacatatatatccagacaagcactgcactcagggcgtcttgttttcacgcaccctgtcacaggacaaaaaatgaacctcatatctgatattccatcagacatgaagtccctgttctagttggtttattttatccttttcgtatgggatatgcccttttaaaacctctttttttatgtagctgtaagtgtattcttctccctttacagagagcatgacaagcagatactcaagcattgcttttgtatcgggatgaatcatgtagtgatccacgcttttttcatagtattccagtgcacttttgtcggtgtacttttctttctgatagttttttgaggcgcttacacggtctataaacatctcgcagacataccttatgggcattttcatgccctccatttttgtatgtgctttatcgtcccccggctttgaaacagcatagtctatccagtactccaggtgatgcttattgcgtcccttatgatgaagccacgcagatgaatagcccctgtcggctctctccgcattattcggactcatataccccttgtaatacctgcagccgacgagaaactcagtcggtgaatattttgacatgtcatgaagaagtccctgtttataaagccctatcctaaagcacccctgcatgactaaaatcttgtgatgtgtaattgttataaaatgtcttattgctttcatatgtctatctgcctatgaggatgtataccgactgcggtgagacatctgcatactgctggttttcacacagcaccggagtgtcataaaacggttctttgagcgtagaatcgcagactttataccatttcattcctttctttagcttaggaagagctaacttctccctggatgaataaaaattgtaagctacgtatacatagtctttattcacttcattgtaatccccacagtacatcacacctacacatagctttgtggcatcacactcgcctatccaggcattcttgcagtggtaggacaaatcaggatacccaacagccttgtaatcgctgaatttaaacggctttggacaggaaataacaggatgctcatccctgaatttgataagtctggttaagaacctgatgttttcccttctgctctgctcatttgaccagttcacccagcctgtagggttgtcctgacagtaagcattgttgttgccatcctgtgaattacagatctcatcacctgccataatcataggcactccctgtgccaaaaacaaaagaagcatggcatccttccacttaagttttcttatctcacggataaacctctttcgcgaaggaccctcacaaccgtaattattgctgaaattccatgaaggaccatcagcatttttctcaccattggcctcattgtggcggtcattgtacatgaataaatcgctcagagtaaagccgttattgcttgatatatagtttataaatccgacattctccccctgctttttctgctggtttaaaagctcatacatattgcagttgatatggtttaacatcatgcgcgccgcaaactggtactcctccttgtcaatatagagattttcatatgtcctgttttgtggtacaaccgacatatcaaagccatcatagagtatcttggtccggctaaggagagcatcctgcacaattgcagtaataggcagcctgttcccaagcagcttaaaaccatctacatgaaagctcatgacccagtatctgagcgcatcgagtatcagattgtggtcagttctgtccggaaaatacatctctacgatacattccatgccatttttgtgcagcctttcaacgagacgcctaagctcattggaggcatctgaagcgtcactggcatatgatgcttttacggcaaaataattgccggaggtatagccccagaaattgaccttgtcattttgcttgtcggtgtgcacactttgctcatcctttaaggaatacttcggctttgcatattccggaatatcgtgctttacagggattgtcatttcctcaaactcgtatacaggcatgagaaggattgaagtaaagcctaatttcttgatgtaatttattctgtccgatacagcctcaaaggtgcccttatgctttttgtcccctgaaacatccatggaaaaacctctaacatgcagcttatacagcttcatccggtccctggttatctcaggaaagctgtcatatttccagtcaaaatcactactgtctatcccgcaggctatttcgtagtcattgtcacttcttgttttatcattccatttttctctgccgaaaattcttgtggcatagggatctatgcacctttttccattaattctaaaataatatgcatattcattcctgcaaaaaccatgaagtctcacagagtaaagtgaacctgtcgaatactcggcaggtatatcaatcacacaggcggtatttcccgatttatcaagtaaaacaatgctgcattcatcctctttttctgctgcaaaggtgaatattgcactatccccctcaatataagcacctgtttttaaaaagtttccctttgttaatcgaaaattcatgcaacaccatccaatcaataattctagtatttatttattatactagttttgactttttttgtatagaataatttgatataatataatagttactttagattactataaagaaagaggtacaatatggcagaaaaagcaacacctgttacacctgatgaggcagacgatatccgcgtaacacttgatctggacaacggaagtgtcgaatgcaagattatcaccatttttgatgcagatcacaaggattacatagctcttctaccgttagacaaaaatggcaacgagaatgagagtggcgaagtatatctgtatcgctatttcgaggacgaggaaggtcttccgagaatagaaaatatcgaatccgacgacgagtacgaggctgctgccgacagattcgatgagcttttggatgacgaaatgtttgatgatatttaatcatctttactattattttgtctaggctctttactttcacggacaaacctggaggcttgggctgatttatcgtttaccgacttgaccgagtaaacagacaagcttgtctttgcacgggtcatgccgacataaaacagccttcgctcctcctctatgtccttttcaagcacagcctttttatacggcattatcccttcatttgcatcaattatatacacgttttcaaattcaagcccctttgagctgtgaagggttgcaagtgtcacggcattagggtcactttctttcgataaagccataagcttcatctgctttgtatattcctttatatgctcataccactcttcataagtagcaaaacccttggcgcctgactggatttcatccagtatatcaaacaaatcctctttatttatattcctatactcggcatattcagctaaaaagtcgtcataaccaatccctcttctgatatagtttatgctggcatatggattcatccggcttataagcttcatgtcatactcaagcttttctatccgctcagctatccacggcttctcatcaaacagcttaatccactcatcaaatgccacagttgcatcacacaggctgtctcttgacagataccgctttggtctgttcataatctgcaaaaaatcagctctgtctctgctgcctgctgcaattctttggtatgtaaacaagtctctggcaatccagtgctcatatatattaggtatattatccttggttttaaatgggatattatagctcataagctgctctataagctgtcttggctgggtatttgtcctgaaaagcaccgcaaagtcgctgaatacagctcctgcctttatctttttatctatatcgcgtatgagaaagatattttcgtctcttctgttttcaaaatcagcaaacgtaacaggcgcctttgacttgcttgccgcaatgattttcttatcaaatctctccctgttgtgcgagatgagattcaacgaggcctccactatatatctaccacatctgtaattagtatctaaaaggattctttttgcatccggatagtccttctcaaacccaagcattatctcaggcttcgaccctctgaagcggtatattgactggtcatcatctcctacaataaacagattattctgtggagcggcaagcatttttataatctcatactgcagacggttaatatcctgaaactcatcaatcagtatgtatttatacttgttctgccacaatgccagtatatcaggtctttccttaaacagctcataagtatacgagagcatatcatcaaaatcaataagcctgttttccttaagccttgtctcatattttttatatatatccctgaatatttcctcaccacacactcccgagtagaaattttctatatcaatgcggctgtttttaatcatactgatttcagcaagtaaattgcctataaactcattctcatccttgtattcaaggcggtagtaggataaaatttccctgataaagccgtatctcacagactcatcagcaatattggcacttgtaaagcgatatgcatatttgagtatcgtaaaaaagacagcatgaaaagtaccaaaagatacgttcaccctctcgtctttcatcagtgaattaaaacgctccttcatctcatttgcagcagccttggtaaaggtgataactaaaatttcagaaggcttcacatgatgctttgttattaagtttttagtcctgtgtgtgataactgcggtcttaccggaacccggtcctgctaaaacaagcatagcgccatccttgtgttcgatggcgccaagctgggctttgttaaaattcataaaataccctttgttaatagattagttattagaaagcttttctatgcctttcttaattctggctatagactcctctttgccaaacacctccataagctctgtagctccgccaggtgtcatctgttttcctgaaacagctgtacggatcggccacataacatagcctatcttataacccttttctgtggcatatgccttaagagtctcaaaaagcgaatcatttgagaaatcatcacagctttcaagaataggaaccacatcgtttaatacctcaagtgatgtctcttggtttgtcttcatcttcttgtgagtatacatggcaatatcataatccggaagctcttcaaagaaatcaatatgttccttgatatcagggaatatctcaatacgtgtctgaaccattcttgctatcttcttaaggtcataatcctttgtgacaacctccttaatgtatggcagtgccatctcatagaatttgtcaaaatcaagcttctttatatactctccgttcatccatttaagctttgtgaagtcaaatacagcaggtgatttgctcatatgatgataatcaaacttctcaacaagctcaggaagtgacatgatctcctgattgtctgaaggactccagccaagaagcgctacaaagtttacaatagcctctgtaaggaatccctgatccagtaaatcttcaaaggatgagtgaccgcatctctttgaaagcttatgatgctcctcatctgtgataagcggacagtgtacatatacaggcacatcccatccaaatgcctcataaagtctgttatacttaggggatgatgaaagatactcgtttcctctgactacatgtgtgatgcccatcaggtgatcatctactacgtttgcgaaattgtatgtaggatatccgtcagatttgataagaatcatatcatcaagctctgcattatctactgtgatatctccgtaaatctcatcctcaaatgtggttgtgccctctgtagggttgttctgtctgatgacatatggcttgccggccgcgagatttgcctcaatctcctcctttgacaggtgtaagcaatgcttgtcatatatagatatttcctttcctgcaacagttgttttaagactgtcaagacgctccttgtcacagaagcagtaatatgcctctcccttgtcaataagttcctttgcatacttcatgtagataccctgtgccacacgctcactctgcacatatggaccgcatccgccatccttgtcaggcccctcatcatggacaagtcctgtctcttcgagtgtcctgtttataatatcaacagcaccctccatctggcgtacctgatctgtatcctctatacggagaatgaaatcaccaccctcatgctttgcaatcaagtaagcatacagtgctgttcttaaatttcctacatgcattcttcctgtcgggcttggtgcaaatcttgttctaatcttactcattttaaaatgtgctcctctatattaatattttttagtcatttttcaatttgaaattatataacaatatggaaattttatcaatcctcagattgaacttccatatcaagctctgcgattttattacctcatatgaatagctttgatatgcggttaaataacatgcgccctgtaatcctctttgtatttcaaaattgtttctttttgtctgccctcatcacaaccatctgaagcttctgaacatacgccctttaatacactgtccagattatttatttcctgctccgtaacactatattccctgacaatacgggcatatcctatgtcgttattatcaagcttataggcatatagacaagaccacagtgattttctgtccccattttgcctgaaagcctcaagatataaatccgctgctatatcaaataaaaacagctgcacataggctgtagccagattgtgatatatgtttccgtacaatacacgctcagtatgctttgcatcctcacatgacagcagctttttgtattcaaaaattgctgcagtgtactttttcttctccatcagtctgtctgccctgattttcaagcactcaaactcgctcttttcctcaagctccttaagtgcatcatgtgtgttcttaagctcctccttagtgcagtagccgctgtactcaagcagttcagtcacaaaagcagacagtctgccgtttgtggatataatggttctaagatgcatggcaagctttggcagatgtgcatggttttcaatccaggtgcacagctcaagactcatgaagtcatcatccaaaagatatgtattgttgattatataataattaagctcctctatcgagtaaacatttatagacacaccctctatgtaatagggcatggctgctatagcttcattacacagtaataattctcccatatgccctcctacatagtcatctcatagtgccagactttgcccgagctcataaatatttcgccaaagcctaaatccttaatctctatatctatcctgtcatcagatacaggtgtcgccgtaattctgatgcgtgtagccctatccggcctaggcggcatatccgtaagtcttagtgtctcaatctttgcctccctgcttttaggaagctgcttccagaaatccacctcataagagcctgaaattataacctcacactgccccttggattcaaaccagttgcttccggcactgataagattataaaacgacagttctcccttatcatgtaccttaaggctcagattgaacttcatctcattctcgcccatatatacaaaaggccattctgcttccttatccctcgtggctgccgcatagcatgctcccttagtaaagaggttattgcccatgaacactcgtctgcccttgcacaaaagtgcaacagactgcttcatccagccctcagcaaacgtatctcccacgagaaagaccgttgagataatctgattcttaaagttctcatttattatatccaaaaagcttttgtccttatcatttttatccagagtatagcttatgctttcatctatagatactacctgtggcgttgtgcgaagatccctctttagggaataaaaaaatatactctccttttcctgcataaacatcaccacatcatgaagccacagtgacttgtcctggttcagtgcaaaataataaaagctctcctttcggtctatgaccgtaagctgtctggaatttatgccaagcctgaccgccatgccataaaacatgctcacgttctcctttgtcagcctgtcaacacatataacaagcctgtcaaaggatgaaggattaccaagcttggatggcagttccataacctttttaagaaacaaggccaaaagctcctctgccataaatgaatcatcatcaatgactattttttcactattcagtgctctcttaagcagctggtcaatacacaccatctcaccgcttttagagagttttcttgcctcatctccataataccatttgccaatgctcttacggcgtgcaagtacaagaggaatctgaaactcctcactgcccgcaacagtgctgacagtctccggctctttcatattctgttgaaaataactaaccatagcatagctgtcatttaagtctatgcctatatagtatgaattgccattatgtcccattataaatcctcttaaatcagcttaaacagctgcttagtagcagcatccagccttttatattcgtttatattgctctttaaggttgtctcatcagacagtgtatctgaaattatcatctcattaatcagattatagcggctgtgatcattgtcacccggtatattgttgcacgtaagacgattgctctctttcacctctatgctgttgtcatgctcctcagtaatataatacctgatcagctcaccgaaaaatatgacaaatgtctttacgtatatgccgtcgtacatctcaaccatatcctctgaattaaactcttcgccatcctcgtctcggctgtaatgcagcacaacatgagtccccggagtactctcatactgtaaaaatgccttgtcatataggaaatatttctccagcagtctgtaatcaagcctcgcaaaaaaatcaaaatacatattgttatatatataatatttaagcaatgtatcttcaatctcaagctcagcctgagtgatatccgttttctcagcaaaatgcttcaatagggctaactggcaggcatcatttaatgttctgtttccaataaatcgcttttcgataatatcaaaaataaaatcagccttgcacccgccactatgcagatatccatgtgccacaagagatatataagctaaaatcagcttttcatttccggctcttttatagtattccataaagatatccgatatcttttcaggctcaatctgcgtataaataccctgttcgagaatacgctcatcaagcttcatggaagatattgaaaacttatcagcggcatgccacagattaatcagctcgtctgtaggcccggtataattttcacacaggtatttaagcaccaggtcactgtatttgcctgttttaaaggcagatatggcaagctgcaccataaaatcatcatctacatgctgcaccttaagcgcattctcacacaaaaccacctttgatgcggcagcaagcatgtctattccatactccatggccatatcatatgccttttcatagaggcggtttgatacaagcatgtcaataagatattttcttgcatccttttgcagggtatcaaaattaatgctttgcaaaaacggcctgacgtaatcctcataatcgtgaagctgacaatattttaaaattctgtatcccataacagctttgtaggaatcagaaaaggattcactataaaatacaggtttaaacagcttcaaatcatcctttgtaaaatcagaataatcccttacatgcttaaaatgtgacactatatactgtggtctgtcaggcgagaggcttatacacctgtcaaggtatttctcggcatccatcagcctctgcagtctgtatgagatgcttttaacatatctatagccccttgagtcctcaaaaagtataacatagtcgtttgaaaacagttcaaaataagcacactggtctgtaaccggaactatctgaggctccttcatttcattctgatatatgatggctctcactatgcgcttatcaaatacaataagcttgtgggtatatataatatctgaaaaagctgccgaaagatcttcattgatgaatcccaactcaagcatatcctcgtataaaacagccagattgtcatcaatatgcctaagctgtgcctggtccatagcaaacctgcccatagctttcctgtacttgtggtagacctcaggctctgtttccttggcagcaattatattattgtaaagcactgcaagctttcggtatggcagcttattatcatagctgaaatacatctggataatcttcggcacaggggaaatctgcctgtcatccatcgtaatgagatacgactcatacaagcctgtcagacgcagcttattctcgatacccagctcaaaccatttatgaaaacagatatcatttttgtgtcccttaatcaggtagctgcatatgatgccaacatactctgcctccggacatatctcataggctgctgtaagaagctcatataccctgttatcgaacccgcctgccagatcaaccgcctcaaaaattgctccggcaagctcctttgtcagagcctttttctttacggcccagcttaggatgcgaagctcaaataccgacagctcctttatcagataaggatcctgtgatatgagataataagcttcaatatacaaatacggagacgaacagcctcgcagtacccagtattttatatctttaagcttaccggcgttgtcatcaaaatactgattcctcaaaaataaaagtacccagaacaaaagcacagagtcaggattttcataaaaaatcagctccacttcgtgtgtcatattgtcaatgtatgaaggctctctctctaacagcgtcatcagatacagataatagccccagattggagctttcttatcaggattactgtgcttgaaatcatcaagaatccacttagcttcctgcctttgcctgttgataataaatgcctgagccttcatcagctcatacatatgctcatccggcacgagtgcatgcaggtggtttaatatgcttatagtctcgtttgcccataccccggtcactatccgcttcagcctgaagccggtataaagctccatgattccgaccatgcattcctttatgtcctttgtcacagctataccacttatgctgccatcatcatctcttacaccggccgtgatatctattgtaaagctctgatatacaccatcaatatatatacggccaaaattacgtccggcatgcattgcagatgcatcgatgatatactcatacagataagttttacctataaaatcatcatgcgttaaaacaggcttagacagctttatgaattcacaatccgtgcgcaggcgtatctcggtatagccccagttatcctttgttatggtaaagcatccactctgtggctctttagaagccataaaaatctcctctgacttgtctacactaatggaaacaggcttttttttgtttacgccaatcagaaactcttccatattctgaccggatggtctggcgcaggcaaagccctcataggtcagcctctcatatacattgtcataaggaattgtgtttaagaaattgcgattataaaacagatgataagcctcatcccaattagatgccgcaagccttgtaaaatcatcaaggctctttacagctccggtggatgcttccgcatagagccttgtgattcttgcacaaaaagaaagactgtactctatctgattgcatacaatcacaaatttgccctcgcaggcatcgccctccgtgagacccttactgttaaattgataacgaatcctgactttctcgccctcaaagtgcggattcagacactccatcctaggattagtcgaataaactatgccacagatttttatctgattcgtactttctattacaaagcttcccgcttcgcttcttccctcaatgaccgaaaggtctattgtctcctctgaaaacgccaaaatcggtttcgtgccattaaatctgccggcagctatctgccctatacgtgctcgcacaattgttaccccgtttacgttaaatgttgattttttatatacatattatataatgtaaattatatacgatttgcaatgctgttgcaatgcaaatagaaaggaaattacagctaatgatagaacaaaaggagcattttcacggcagtgaccttgaaaaaatagaaaaaatatacggtataaagaaagaaaatattgtgagctttgcagcaaatgtcaacccactcggtgaatctggtaaactaaaaactgcactgtctgagcgcattgatgcaatcacaaaataccctgacagggagtatacttctctcagaaaggctatcggcagctactgcaagtgcgattacaatcacataacagtcgggaacggatgcacggagctcatctcacttttcattcagattacagctcctaaaaagacgcttctgttaggcccgacttactctgagtacgagcgcgacttaaggataaacggcagtgatatctcctactattttctcaaggaagaggatgattttaggattgatccggatgaattcatctctgcaatcacagctgataccgaccttgtcatcatctgtaatcccaacaatccgaccggcagtcttatcacaccggataagctcaaaacgattttaacccactgtaaagagacaaatacttatgtgatgatagacgagacatatatagagtttgtgccggatgttgatgagctttcagcaatacctctgactgaattgtttgacaatgtgattattttacgcggcacatccaagttttttgccactccgggacttcgtctgggctatgccatcacatcaaattcacaaattcttacagacataaacacaaacaaaaatccatggatgattaactctctcgccgttgttgcaggcgaaaccatgtttttggatgaagaatatataggtaaaacaagaagcttgatactttcggagaaaaccagatgcaggcaattaattgaagaatcacacaaattcaagctttatccatcctacagcaacttctatctgcttaagatacttgatgaaagcgtggatgcacatatgctatttgagcgcgccataaggcagggcatgatgataagggactgctctaccttccccggacttgaggagcgcttcatacgattttgtataatgaagccagaggacaacacaaggcttattaattgccttacacaatgatgctaaatgcctttatataaacataacatataaccaaaaagcctccggaaggatttaatccagccggaggcttttttataaagtgaaacatagaatatgctttaaggtctatattattttgcagataagaactcatcaataccctttgctgctgcttttcctgcacccatggcaagaataaccgttgcagcacctgttacggcatctccacctgcaaatacaccctcttttgaggttgcacctgtatcctcagttgctacaatacactttctcttatttgtatcgagacctattgttgtagaggaaataagtggatttggagatgtaccaagtgacatgatcactgtatcgcactccatctcatactcagagccgggaatctcaatagggcttctacgtcctgatgcatcaggctctccaagctccatctttataagcttaacacccttaacccagccattctcatcaacaagaatctctgtagggttctcaaggagatcaaagataactccctcttccttggcatgatgtacttcctctttacgtgcaggaagctctgcctcactacgtctgtatacaatgtgtgtctcagcaccgagacgaagagctgttctggctgcgtccatggctacgtttccaccaccgacaactacaacctttttaccttttgagataggagtctcataaccctctttaaaagctttcatgaggttatttcttgtaaggaactcattagcagaaaatacaccgttggcctgctctccagggatccccataaatcttggaagtcctgctcccgaaccaataaatacagcctcgaagccttcttcctccataagttcgtcaatcttaactgactttccgataactacatttgtctcgattttaacaccaagtgccttgacattctctacttctgccgcaacaaccttgtcctttggaagacgaaactccggtattccgtagcttaatactccgccggcagcgtgaagtgcctcaaaaatagttacatcatagccaagctttgcaaggtctccggcacatgtaagtccagcaggacctgaaccgataacagcaacctttttgccgtttttctctgcggctgtctttggcttgatgccattctctctggctgtatcagcaacaaatctctcgagctttccgattgagacaggatcgcccttgaatcctctgatacacttgccctcacactggctctcctgtgggcatacacgtccacatacagcaggaagtgctgatgactctgaaataatctcataagcctttgtgaaatcaccatttttaacctgctcaacaaatgcaggaatattgatagaaacagggcagcccttcatacactgtgcatttttacagtttaagcatctgcttgcctctgccattgcctcttctttattgtagccgtagcaaacctcttcaaagtttgtggcacgaacctttggatcctgctctctgacaggtactctctttaatacatcgacttccattatttgtcacctccgcagtttccgcagccaccgtgatgtgttgcgccctcttcataggcaagcttagctctgccttcctctgtcttatattgctgctgtctcttcatagcctgatcaaaatcaacaagatgtccgtcaaactcaggtccgtcaacacatgcgaacttaacctttccgtccacgatcagacggcatgcaccacacatacctgttccatcaaccatgattgggttcattgaaacaattgtaggaatctcaagcttctttgtgagcagacatgtgaatttcatcataatcataggtccgatagctacacagcagtcatatgtattgccggcatcaacaagtgcctgaagctgctggctgccgttgccgtggaagccgtatgagccatcatctgtacaaacatagagattctttgcaacagctttcatctcatcctcaaagaaaaggatatccttatttctaaagcccatgatgacatcagcctccacaccatgctctttaagccacttaacctgtggatatacaggagctgtaccaagacctcctgcgataaatacgatgtgctttttctttgtctcctcgaggttatcctcctgacaaagctctgatggacagccgagtggtccgacgaaatcctctaatgaatccccctcattaagagccatcattctctctgttcctgcaccgatagtctgtactacgatagtaacagtctctttttccctgtcataatcacagatggtaagtgggattctctctcctacctcatctgtctttgcgatgataaactgaccaggcagacactcttttgcaactcgtggtgcctttatatccataaggataatattgtcagccaatttttcttttcgaactattggatacatagtcttcctcctagttaaatcttatcccattacatatgtaatctgatactcatttatttcatacttttttaattttaaatgaaatgatataatttttcaatatgtttctttggatattccataaaaatatgttatatgcttatgaaattgtgttatcttttgacattcgtccggtactttatatcaaaaacaggaaccaattcatgcaaaaaatgaaccggttcctgtatttatcagcttttatgagaaatatacaagctcatcctgcggcttctcggcaggctcgatggaaaccggataaagcaccggtccctttcccttgtactctcttgcaaactccacatgcacccttgcggtgatggtaatccacgatttgtgaggaatactgctctcatcctcatacttgcacttaaagcctataaaggtcacgtcctctatacagcaggtcatcgcaaacctgcccggtaccataacaccctttctaagcttatcaggattgtatacaagagcaagaaatttgacaaccttgccgtcgtacttcttgtaattctccatggcatccatataccagatggcataatctgcatctgaaagctcaatcacatcctgatttatatcaaacggcagttcctccggacgctcatcaatagtaccatccttgcgttcgtagactatctgggctttgcggttgatattctttatggtacgccttaggtgtcctctgtctgtatcatcgtccgtcctgttaaatatgacaacatcactcgcaaatacctgttcctgcatcatcgcgcgcatattgttcatataaaggtcaaatgtagtggaatcaactgtggcgagcgactgcacgataacccagccctttggcagctcggcctctattattttatcaatgccccatgtgccgttgtactcgataaacacctgttcaggcaaatactgcatgttgagctcattcagctttgcagctgtgaactcatcctccgagtcgatctctgcaacctggatattggcagcctttagcttatccatatcatactccacatcaccatcctcgcacataatgataagcccctttgagccattagcaaaatcattctcgaaaatggtatccttaatcagtgaagtcttgccactgtccatgaatccggtaaataaatatactggaatctcttcagccattttgttagttcctttctgattattgtgtaactatattaaatacatttaagcaagtccgaaaagctcttcaagctcatgctcgtggatatctgttccgataacaactatacgtcctgtatagtcaggctcgccatcacgaatctcgtactcgcccggaaccatatcaaagtaaatccacttgccgtctgtgccctctaccatgccctttgaacgaagaatcttgtcatcttccacaaactgcttaaggatttcttcgagcttagcgcgctcaaacttgtgaggtgtctccttgccccagcttgtaaatacatcatcagcatgatgatgtccgtgctcatgatcatggtcatgacagccgcaagtgcagccctcgccatgctcgtgatggtgctcatgttcgtcgtggtcatggtgatgttcatgctcatcatggtcgtggtgatgttcatgctcatcatggtcatgatgatgctcgtgctcgtcatggtcgtggtgatgctcatgctcatcatggtcatggtgatgatgatgctctgcctcatcctgtgcatgacgcgcctcagcaagcaccttcatctcgagattatcctgaccttccatagtcttaagaatctgctctcctttaatagcatcccaatcagtagtgataactgaagcctttggatttaaagcctgaatctgctttacacaaaactcaagctgctcaggtgtagcattctggctgcggcttaagatcactgttgtggcatactctatctgattgttgaaaaactcaccgaaagccttcatctgcttgcttgccttaagtgcatttaccactgtaacaagtgcattaagcttgaccggctgttctttttcgatatctataacagatttcatgacatctgataatttacccacgccggaaggctcgattaagatacggtcaggatgatacttagtaataacctcatttaagttcttaccaaaatcaccaaccagtgaacagcagatacagcctgagttcatctcagtaatctgaatgccggcatcctttaaaaagccaccgtctataccaacctcgccgaactcattctctatgagaactatctgctcacccttaaaagcctcatctatcattttcttgataaatgtagtctttccagctccaaggaaacctgaaataatgtcaatttttgtcattgtaattcactccttttcttttcactaagtcctattttactagcaataatacaaatatgcaaattaaatttttattattaaattatgttgacacataacaaaagaactaccgcacgcggtagtcctctctaatacattaattgtattttctttttctagctgcttcagatttcttcttacgctttacgcttggtttctcgtaatgctcacgcttacggatctcctgctggatgcctgcttttgcacagtttctcttgaatctgcgtaatgcgctatctaaagtctcgttttctttaactattacactagacataacctaaaacctaacctccctccagttgtgtattgtgcatcaactgttaggtatctatacttaattgcactaacatgtattttatcaaaatatccggatttgtcaagataaatccggatattttttaaagaaattattattttagttatatcaggtaaaaaatcactccaaaatgactctaatcaagcttgataaagattgatgtttcctttttcagtgaatctgcaatctcatagttttcatccatcttgtgtgagatattgtccatatcctcaacaataagctgtgtactgtcagccgctgaaaccactccgttcacaccctcatttatagcatgtgatatggtgttgattgaagaagaaatctcaagcatggactgcttcagtgaatcagtcttctccttgaaatcagtcatggtaccctcaatgaatgaagccttgtcgttgtactccacaccggactcaacaaatctctcaaactccggaagaatcgaatcattaatatagctgacaagaccattggcgttgtcagaaagattggtaaccgaattggtaactaccgcattgatacgctggatattgttggctgcctcctggctggctgcagcaagctggcttatctcactggctacaaccgcaaaacctctgcctgcctctcctgcccttgctgcctcaatagaagcatttaatgccagcagattggtctgacttgcaatgtttaaaatatcattggtaagtgaattgacctgctttacgctgttgctatcctcaatagccttctgcaatacctcgagaatctccgaaaccttcctgtctgttgactccatgtttgtacgtgcaacagactccattgactgtgcatgagccttcatatccttggtgtatccggtcagttcatctgtcttttcagcaataagctcaacctcttttgccacattatctgtgttggtattgataacagatgcgttttcggagatatcctgcatggtagcagacagctcctctgttaaagccgaaagatcggacacactgctgttgcttgtctgaacactctgacgcacatcatcaacaaccctctccatcctggccgagtttgtaacaacagccttgaatatagcctgcagctttgtcataaagacattgatgcccttgcctacggcgtcaacctcagcattgttgataggagtaaccctctgcgtcaaatcgcccttcttgttatcaatattgactatgatgccgttgatttccttctgtgtacgaagcagaggcttgataaccatggtgacaacagcaaaaacaacaaacagtaacgcaattatacttactgcaatagtaaatgtacatgtgacaacagatgcgcgataagtactttcgaggctctttctctcctcctgtgtaacagaattgacatgctcacgcattgacgaaatagctttttcaatgttattagaatattttgcaatagagccatttgccgttttatacgcttcctcgtttttaccggcggcagaataggccattacattgccacactccttgaccaggcttgtatagttttcacagataattctatagtttctcttggtctccaaggttacataaggattataatcatcaaggagctgctttagcttttcctcgtgatttctcacttcacttacaatatcaatcattgatgatagatctgtcgatataatatgagccagtgccagtgtatgaatattcacagtctccatctcaatatcattaagcatctccgtgccaaccattgaggtgtccacaatctgagaagcagcatcatttacctttgataaatttttaagagataaaccacttgaaataacacttacaaagcctacaacaaaaacaggaataagtatcaattttgtacttaactttttctttcccttgacctttggtttgttattaaccttttgagctttttttgtgttgagagtttttttaacttttggtgcttttgcaggatttgctgcttttgctttcacctttttttgttttactgcgctatttttaacagctgctttacttttttttgaatctaatttcatgttatatacccctctactcagctacagattgtgttatccccgcaacaaaattatccattatctcctgaagatctgtattatcaggattaccggccgccattttttcgccaaactccgtcgcagcatcccagtaagaatttccaactctttggagctttccgtactgtgcctgatccataacagccataatagcaggaacctttttgaccgcatcatctgcggctgccgctttattggcagggcctacattcttcatctcaaagcgtagcttctggttatcctcgtttgtaaaccactgggcaagcttatttgcccactcaggatacttggtgtatgcatttacagccatatatttatagcctttaaacgatgacatctgaatctgctgtccggcacatgtgtatgtaggtagctttacagcaccataatcatcgccccataattccttgatttttgctgcattccagcatccactgacaccggcaataatacttccgtcctgtactcctgcaataaaatcgtcctgtacacagttcttaaagcccggcttagccgcaatatcaagcatagcctgtgctatatcaacacccttgatgtccgtgatgatagaattccagttacagtggtttgtcacaccatcatcattcacgccaaaatcaagccctgtatttccaaaaaatgaatacagataccagcctgagctccagtccatagtcaagtacttaccattggctcctgcaatgtcaagcatgccatcaagcgtagccacatcgctgtctgagaaataattcttattgtaatacataaaatatccattgtcagcggtcagcggatatccatataatttgccatcgatagtggcagcctcaaccgcaccttcatcgtcagcctttttaacggcatccacatcctctatctcataaagagcgcctcccgctaccatagaagttatctggtcatccgctatagggaatacatccgcaccattatgcacatttgataatatattatctctggcatcagaatcctctgactcctcgataattatattaaaatcagttcctttattagcctccttgaagctttcaatcatctgtgtagtaatatccacatcatccttcgaacaccacacatgcatctttacttccttattcttcgctttatccgaagaattctccgtcgtacccacctgagtattgtcatgtgatttatttgatactccacatcctgtaagtaatgaaacccccatggcagccacaagtgttgcagctattaacctcttcatacatattcatcctttcagtttattctcaatttataatttagtacaattttaccatactttcacaaaaaaaaataggtctaatttgatttttttaacaaatttagacctattttttaaaagatgcattttaaagcactatataagcatttttgttacttaatcatacctgaaagtgcgtcctttactgaagcaatagcatcaggaatacctgccgggttctttccaccggcctgagccatgttagggcgtccaccgccgccaccgcctacctttgaggcgattgccttgattaagtttcctgcatgcgcaccgctctttatggcagcgtctgttgccatggcaacaagatttaccttgccttcatttgaagaagcaagcacgataactccctcgccaagcttttccttgagggaatcgccaagatcacgcagtccgttcatatcaacgccgtcaacacttgttgcaagaagcttgatgccgtttacatcaactacctgatccataacatcgccgagcgcatcctttgctgccttgctcttaagagactcattctcactctgaagtgccttcatctcagccatcaagtgctcaagtctctctttgaggtttgcaggagttgatttaacaaccttagcagcctcctcaagctccttctccatattgctgtaataagcgaatacattgtcgcctgtgatagcctcgatacgtcttacgcctgcagccacaccactctccgaaagaatcttgaataccttgatatcagatgtattctttacatgtgtaccaccgcagaactcctttgagaaatcgcccattgatacgacacgtaccttttcaccgtatttctcgccgaagagagccatggcacctgtctttttagcctcatcgacagtcatgatatctgtgcgaacttcaatagcttcgttgattttctcgtttacgatatcctcaacccttttaagctcctcagcagtcatagcagaaaaatgagagaaatcaaaacgtgttctctcagcatcctgataagaacctgcctgctctacatgtgtgccgagtacctcacgcagtgccttctgaagcagatgagtggcagagtgatttctgcatgtgtttgttcttgtttttgtatcaacagcaagtgtagccttctcgcctgtgcggatcataccctctgacacataacctacatgtgcatatctgttgccgactacctttacagtatcctcaacaacaaatgtaccgctctctgtctttatgatacccttgtcaccctgctgaccacccattgttgcatagaaaggtgtgtttggcacgattacagagcccttatcaccatctgaaagagcctcgactacatcatccgatgtggtaaggaaagcaatctcagctgtgtcagtaagcttgtcatagcctgtgaactctgtagtaatttcagaatctatatcattgtaaacattggcatcagcacccatatagtttgtttccttgcgggctcctcttgccttctgtctctgagcctccatacaactctcaaagccagcctcatcatatgtgaagcccttctcctcgagaatctctgccgtgaggtctacagggaagccgtatgtatcgtaaagcttgaatgcatcctctcctgaaagtaccttgaccccgtcagccttcatatgctcttccatatctgcaaggataccaagtccctggtcgatagtcttcgcgaacttctcctcttcctgagtgagcaccttaaggatgaaatcctttctctcctcaagctccggataaccgtccttgctctcatcaatgacaacctgcgcgatttttccaaggaatgctccctgtatgccaagtgtacgtccgtgcatagcggcacgtctgatgatacggcgaagcacatagcccctgccctcgttagatggcataactccgtcagaaataaggaatgtagacgaacggatatggtctgtgataagacggatagaaacatcgtccatctcatcgacatgatatttcttgcctgaaagctcgcagaccttgtcacggatagccttcattgtatcaatatcgaataccgaatcaacatcctgcattacaacagcaagacgctcaagtcccatacctgtatcaatgttcttgtgctcaagctcagtgtatccaccgtgtccgtcaccgttaaactgtgtgaatacattgttccacacctccatgaaacggtcgcagtcacagcctaccttacaatcaggctttccacagccatacttctcaccgcggtcataataaatctcagagcacggaccgcaaggacctgcaccatgctcccagaagttgtcacactcgcctgtctcagggtctctgtagaaacgtgtaatacgatctcccggcactccaacttccttggtccagatatcaaaggcctcatcatcctcaccgtagatggaaggataaagcctgtccttctcaaggccgagcacctctgtcaaaaactcccatgaccatgcgattgcctcatgcttgaaataatcgccgaatgagaaatttccgagcatctcgaaaaatgtaaggtgacgagctgtcttacctacgttctcgatatcacctgttctgacacacttctgacatgtagtcacacggcgtcttggcggaacctcctgtcctgtaaaatatggtttaagcggtgccatacctgcattaataagaagcagactgttgtcattgtgaggcaccagtgaaaaactcttcattgcgagatgtcccttgctctcaaagaactcaaggtacatacgacgtaattcgttaacgccataactcttcttcattacttgaatctcctattcttttgtctttgcgtccttcattttacgaagctttacccctattaaagccccacaaaaacctatggccgccaaaacaatcataataataacatattgtgctacgcacatgaaaaagtcccccataattaccctcctaaatttattgaactaatttattataaatgaatttgtgaaataattcaatagttctctccaaaagcgaacgtctgattttcacgttcaatctcaatcaccctgtcagccatgtccttattgctcagcctctttttgtattcagtaataccgctgtagtcctgccacatgtgcataggaaacacaaactctgccgaggtattttgtaaaaagaaatcaaaacccttgaactgatactccataagctttggatccatagggaaaaaagccacgtttattggtttttccgaaagcttttttatctcatgcctgaaggctctgcgcactctgccgtttatcaggtctcctgcgccatcccactcccagtcgtttaaatcaccggcatgaaacaggctcactccgttagaaatgacgtaaaacgccacaccggcatcggtggatctaagtgtcattatatccagatcatccacatgatatgtattgtcaggtgaaacaaatgtcaccctgtccctgacagcaggatcaatgccatgctttgacaaaaaatgcggactgatacggatatcctttgaaaaaacataatgtatattcggatatttgtcagccagacgcaaaatatccatatcataatgatccttgtggctgtgacttgcaaacatatagatttttgtatccggctcataagatggcagctttccggtaaaatgcataccctccaccttgtctccatcaaaataatcaaatataagcaccttgtcatccagttccacaagaaaacaactgtgatgtataaaaattatctgcatgtaacctactctctttcgtttttttctctctttccgcaaagaaatcagtctttatgtatcattatgctatctttatgcaatatagtcaacttatatttcgtataatatagtaattaaactctaactaccaatcaataattatatgattaaagggtcaaaataccttttgaccctcatatcattatataattatacaaatcatgccgccatttgagtcattcacaatcttttgcatggtttcctgaagctttatctggcactcatcatccatctgcattattttgcttcttattccgtcctccataagctcaccgacagactttccaaaaatattagtcttccagactccactgtcactgttttcaccatttttgatgtaatctatcaaatcctctgcctgttccctgcttccgactatcggcgctatctcggtctcgatattagcccttatcatatgtattgacggtgaaatagccttcatttttacgccaaacttgtttccatgggctataagcaccggctcctccattctgatatcagacagctgtggcatcacaacaccataacccttctgctgcaccgatgaaaaagcatccttaatcttttcgtactcattcttttcctcagtgagtgaaagaatcagggaaatcagctccttttccccggaaacagtcacaccgcacaacgcggaaatattctcgtagtagtacttctctgcaatctcaattttaacctttaccacaccatcagacagccccatcccggcaagagataccacttttaatatatccccatccgattcaggcatatcagtgctcatctgtgcgacatccttcagctttgaagaccttgcaagaaaagtctttgcatatgtaattacggcctgctttacataattgtcataaggcagaagctgcacccatttcggtatatcatagtccactctcgtgactgcaaattcatataagagcttttccatgatatctgtaatctgtcccatgcaaagtttttcacagtctataggaatagcagccgctttatactctctgctaagtgactcgcataaaagtctcgtttctgccgcaaaaggctttgtagtatttaccacaattacaaatggctttcctgaagcctcaagctgcatgacggtttctctttctgcagcctcatagctctgtctttttatatcgcctatgctgccgtcagtggttacaagcacagccactgtcgaatgctcctctattaccttttttgtacctacaactgcagcctcctcaaaaggtatatcctcgtcgaaccacggtgttttgaccatacgctcgccgtcctcctcgagataaccgacagcatcccccactgtaaagcccacacagtccacaaggcgtaccttcacagcgctgccatcatccagactgatagtaaccgcatcctgtggaataaatttcggttcagtcgtcataatagtctttcctttgcctgattgcggcagttcatcgactgcacgctttttagcatactcattgtccatctttgggattacacaaagctccatgaaatgctttataaatgtggacttgcctgtgcgcacaggaccgacgacacctatgtaaatctcgccgtttgtgcggcatctgatatctttatataaatcaaactctttactgtccatagtactgcccataaaagcttcctccatacactttattctataatcaaagtgtattcacccgctctttgaattattacacataaaaaggccacaggcttcaaaacagataacctgtggtcttttgtaataacatataatattttaaaccaaactacttagcagcctttttctcacatcctgctgtcttgcttgtagaagtatcagctgtttctttagcatctgatttgtcagaagcctcctcaggctcctctctcagacgtgcatacatctgcatacacttgtggagcttctttgcaagcttattgtctatctgctcaggagtagctctccactgccagttgccaccggtagttgaaggaatgttgatacgggcctttgaatcaagtccaagcagatcctgcataggaacaatagccatatcggcaactgatgaccatgccgcacgcatcatgccccagttgtagccctcctcctttgtgaggtttaagtaatcctttgcaaaccttacgcaatcctttggagctgtcttcatccagcccataactgtgtcattgtcatgggtacctgtgtatacaacacagtgctgcggatagttatgtggcagataatcgctatcttctcttgaatcgaaggcaaactggataaccttcatgccagggaagcctgaatcctttaaaagcttctttacggaaggtgtgaggaagccgaggtcctccacgatgataggaagcttgccaagcttcttctcaagcacgttgaataaatccatgccaggtccatctttccatacaccgttctttgctgtatcatcctttgcaggaatagcatagaatgaatcaaaacctctgaaatgatcgattcgcactatatcataaagctttgccatagcactgatacgctttgtccaccagctgtagctgtccttcttcataacatcccatctgaaaagaggattgccccagagctgtccgtcagctgagaaggcatcaggaggacatcctgccacctcgattggatttaagtctttatcgagatagaactgtgtaggattagcccatacatctgctgaatccatggcaacataaataggtacatctccgataattcttatgcccttttcattagcatatgcctttaaagcagtccactgcttgaagaagagatactggagcatcttgtagaaggcaatatcatcagcatacttctcctttgcttcttccatagcctcaggttttctcaacttgagagcatcatcccactcgctccatgccactccgccattggcatcctttaatgccataaagagtgtgtactcatcaagccactctgcctctttgctgcagaatgcttcatagtcagccggtgttttctttgaaaaacgctcatatgcctttcttaaaagagcatatctgttgacatacatgatgccatagtctacatactgtggctttttgccccacttatatgactcgcactccttctttgtcagaagcttgtccttgcataaaagctccagatcgataaaataaggattgcctgcaaagcttgaaaatgactggtatggagaatctccatagctggtaggacagattggaagaatctgccagtatgtctgacctcccttctcaaggaaatcgacaaaacgtctcgcctcctttcccatagttccaataccatactgtgatggcagtgatgagattggcattaatacaccgctagttctcatgttatttttcctcccttttgttgtatacgcattgtttggctgcgtgagcctgtattttaaaataatatataatatacatatgaaatcatatgatattttcgttttatttagttattataacatcataaagtgcaacttgtaaattaaattagttaatgttaatatcaaattaataaaaagtttaaaagaggtgtaacaaaatgaatgaaacaaccaggcaattgattgtgcataaggtaaagcataatacgaaacgccttataacatccattaaatgggtaatcttttctatcgttgtcggcatagtcgcaggaagctgcggcaccgcattttattttgccctgtcggtcgtaaccgatttcagaatgaaatacccttggctcatttactttctgccaatcggcggacttgccattgtaggactctatcatctgtgtaaagacgataacgacaccggaaccaatctggtaatatcagctatccattcaggcgacaaggtgccctttataatggccccgcttatatttgtatccacacttatcactcacctgttcggtggctctgccggccgtgagggtgctgcactgcagatgggaggcagcatcggaagctctataggcagggtattcagatttgatgaaaaggacaagcatgtcatgattatgtgtggcatgagcgctgcattcagtgcattgtttggtactccgatggcagccgctattttttccatggagatgataagcgtcggtgtcatgtattatatagcactcgttccatgtgtgataagctccctcatcgctcacggtatcgcatcatacttcaatgttacaaatgaattttttgctattgaaaacataccggactttactattttaaactcagtaaaaatatctgtgcttgcaatactgtgcgcactcgtaagcatactcttttgtgtggcccttcactcaagtgaggcgctgtacaaaaaatatctgcctaacaaatatacaagagtattcattggtggctgctttgtcatcatagcaactatgcttgtaggaaaccagacatacaacggaaccggaatgagtgtcatccaaagcagtatagacggctctgtcagacctgaagcatttctgctaaaaatcatcttcaccgcactgactcttggcgcaggctttaagggcggcgagattgtaccatcctttttcataggcgcaacatttggatgcctgttcggcaatctgacaggctttgagccatcgctgtgtacagctgtcggcatgatttcactgttctgtggtgtcaccaattgtccgattacatcgctgctcatcagctttgagctgtttggctacgacggcatgccgtactttcttttggcaattccattcagctatatgctgtcaggatactttggcctgtatcgcagccagaaaatcgtatattcaaaatacaagacaagctacataaataaatcaactcactaacatttgctaactgcaaccaggcatgataccccaggtattattgcctggtcttttattgtgtaaagagctttatctcccgcagaagcttcatctgcaagaacctcccacaaagcatctgcaagtttaattgtgattttatttttgccggcattgtaagctacgaacaccttctctgtatcgttatcaatagtatatgctacaacaccatcaggcatatcatccatgaaatgtatggatttcttaatctcatctactgtgtcaagataaaatgacttgtgagcccttcttagtgctataagccccttatagtaggctttaaggcccgaaaactgctcagccctgtcataatctattgcattgacagagagaggactgcaatagctgttctctacaggagcaccatcagcctcactaatctttgttctcgcaaactcctctccatgcaggaaaaacggaatcccctgcgctgtaaaaaggatggctgctgcaagcttattcatacggatacgcatctcttcactctcatgtgaattggatatgataaacctgtcccagagagtatagttgtcgtgacatgacagatagttaatcgactgcataggcgatttggcccacttagcacacgtaacagcctgctttagctcttcacctctgtctgcagctccattgacaaagcccagctcatccatatagaacacatgtccctttaccgcatcacgtatatcatccgaaaacatgccgatgcccggtgtccttggagcatttattttcatgccacgctctgattctggcagagtgctctctccacctgtccagccctctccgtacattattatatcaggatttatttttaagagagcttttctggcttcgttcaatgtctcgatatcaagtactcccatcagatcaaacctgaagccatcaatatgatactcactcgcccagtagcacagcgaatcaatgatatattttctgaccataggcttctctgaggctatttcattgccacaggctgatgcatcagagtactttgcagcatcaagcatgcggtagaaataattgcccgcagtcttgtaaaagcagctgtcatgaacattgaaggtatgattgtaaaccacatccatgattacaccaagacccgcctcatgaatcgagtgtaccatctccttatactctctcactctcacggctccattaaacggatcagtcgagtaagagccctccggcacattgtaattgtacggatcatagccccagttatactgctcctttaaggaatcactctcatcaatgctggcaaaatcatacgacggcataagctgcagatgtgtcactcccatatccttgaaatacgaaagagttttatcctcagtaaatgccttaaacttacccggatacctggaatgagcagatgcaccggcagacacatccgcgacagacacctcagtgataaccatgctcatgggatctgcaagctttggcctgtcctcatctgcaaatccatcaggattagtctttgacaagtcaataaccatagacctgtgcccatttacaccgcaggctcttgcatacggatcatgcgagctgaatgtgccatctgcggtatgaacctcatatgtataataaacaccatccagatttccctctgcagtagcagaaaaaatactgcgaagctctccctctccgcgcatcatctcaagcctgcctgtctcggccgaatcatttcccttatcataaaaaataacaaaaacactgtccgcaacaggcgaaaacagtgtaaatgttgtcttttcctttgaataaatcgctcctaatttcatagcactatccttttcgtttattttcgtatacattataataaaatttacaataactgtaaatagggcaattcaaccaattttcaaaaactttttagtcaatgtgccattttttcttttgctgatgtgaaacaatctttatatacaaagattgtggtagaaatctgccacaggttgtagcaagcttcatcctgagagtaggcactatgaccgttttgtgcttcatcatccggtctatggcataattggcgcagtattcagcggaaatccccttcagcgcaaatcgcacattcgccacatcattgaactccgtatcaaccggtcccggacacagacaccccacatacacatggctgtggctctgtcgaagctcacatgcaacagcccttgaaaggctcgcaacatatgccttagaggcataataggtagccatgtacggaccggcaggaataagccccgcagagcttgccacatttaagataaaacctctgtcctttaccctcatttgtcttaaaagctttttcgtcaggaagtgtacagcacgcacgttgacatctatcatgcccatttccttagctatatcagtctcctcaaacaggccacaatcaccgtagcctgcgttgtttataaatatttctatatctttttcctcgagatagtccgaaagtctctgacactcatcaagctgcatcagatccgcggtaaaaatatcacactcaagctccttatgtgtggctttgagcttatcagaaagagctgtaagcctctcccgccttctggcaacaagaatcaggtcatacccctccttcgcaagtctctttgcaaactgctcacctattcctgagcttgctcctgtaatcactgcatacatatatcatatcccctattcttcaatcataagctccctggagctcgcatcaagctctacgcttgtgttgtcactcttatacatctcaagcagcaatagccacagcgtgtgaatctcgtatatgagaatattagatgccggcactgagtatggaagcagtgtgctgatatcaaagtatctgatgccaagcggcggtaaaaaaacaaggttggttgtctgtcttttatcaccggcagtatgaatcatctcatatgtaatcatcacgaaatcactgcccttataggtacactcatatgacacgtagcactcatcaacagtccaggtgatgccatcctctgtaactgtcggctttacagcctcatcattgtactctgtagtctgacaggaaagcttccacttaatctgccccttctttgtttcctttaccatatcggtaagctctttaagtaattcatcttcttttttcatattatacacctgttttcattatcaatgctcatcaactctcacaccatgtaccacaaacctgtatgtctcaccgcttgtggagcaggttgaaagagtcacaaccttgtcatcctttgttgggactatgcctgtatccttcattgatgaggcagccatcctctgtacgaatttaccaaatgtctcgtcaggctcaaagcccacagtatactcatcgctgtcatcgcttaccgtttcatatgagaaaatttggtacctatactttttgccatcgacaagtatctggaaatactgatggctgtcatagtaattctcatcacggttatagtacttaagctttccaaacatcgacaggtttttcatattgtgtccataaatgattgtgtggcagtcgctgaaatcagtcttgtttgaaccctcaaggaagatggagcctgcagtggcatgctctctcttaaaggtctttctgaggtaatagctattatcccccgaatacatgacagggtagctgatatcctcattctcaaaataaatccagccaaccacatcagggttttcgcttcttagaccggcgaaatcaatatctatatcatcataccacggagactgtgcttcactgcctttcgtgctgtcatcatccttctttgaatcgtccactgcatactcatcctgaagcttctcatatgtcttatccgaggtattatagtcagaataaatcttaaacagatgataacccgaataagccacaagagacaaaccgattatcagaactataaatctaattactttcttaaccatttgttttctccatttttttatcagtcagtactgtaataccggtaaaaataatcaacaatacaatgaataccaatttaccttgcgcggttcctaaaaaagaagcaggataaccaagcaccgggatatcaaacacaggcacaccgaccacatcagaccatgcaaccggctgtacatcattcacctgattggcatcgccctttgtaatgtaggtcttttcatctgtatttatctcaactaccctgtgagtcacaagctcgccatttctgtaaaaggtaatgacatcacctgtctgtatcccaccggcactctcctttacatacaataggctccccttcatgtaagaaggctccatgcttccgcttacaactaccatcggctcgatactaaacagcttgggagcaaatattacaataataattaaaataagaattaataaaattatactggaaataatgttaataagtctcttcaaaaaaagcacctctatatcagaaaatatcatttgtcactcacaaaactgctgtagcagcttaccggctcaatatcaaattgtatcgtcatattactatgtgtgtcacacgtatgattgaacctatcgataatacgcttcatgacatcggaggctgtatcgcatgagcacttcgacaaaagcacaatgtactgtgaatcactgtactttgctgccacatcacccacacgcaggcactttctaagtgctctttcaagtgtatgcatggaatccttcatctgactatgattcttatccggctgactgctatacattggcacaacagtgacaagcaccagactctccggaatcgtagaacgggcactctttctgacctccagctgatagatttccttgaacacaggatatccgcacatgaaaacaccattcatgctctcctcactgatatcgtccttcacttcatctatattgtagcttgaagcaccctttgtgacagataaaagctcctcatacaccttgttgagcatgacagtctttctaacgccaagatccttgtccataatagccttggcagtctcataagtatcaaaagccatctgtacctttttggtacgcatgcgtgctacaatcagatatgagtatatctgctcatccgaacgttcatatacaatagccctggtgcaaagctgctcaagcttctcatagcagcctgtatcaatatacagctttgccagagcctttactgtatttacgtatctggaatggtaaaatgcattgagcgtcataaaccagtgtgtatctgtcctaagaggcaggaaatctccatggtaaagggctatggccttctcatagctttcaatagcggtctccttgctcctgcaaaatgccatctcagcctcatttatatatctgtcaaactcttcgacatcaatggttacttccacatcatcattccatttgtacaagccgcctctaacagaaactatgcactcctcgccaaaggaggcatctcttagagcctttctgagcctgtatgccagatttttaagggctcctaccggattatcagtctcctcctcaacctgccatatagcctctgaaatatcctctatacagacacccctgtttctgttcatcgccagatatacaaacagcttttcaagcttctcagaccgccatgccccttcctggacaaatgttaagtcattacctaccgtaaagctgccaaaagtttttaatttaatcatataaatctccccatttctgacattaaacattatatagtcataaacatattaatctttttggaatccctataagactcaaaaattaaacccagattaaaatttacgcaaatcatcactgccgtcgtcgacagtattttgtattttcattatcttaacaaagtatgagtagtcatcatttacctttacctcacacctgtcacccaccttgtgcccgaatatagctgcaccaagcggtgactccttgcttatcagattctttaaggaattgccccttactgttgtgacaatcttgtatgtctcagtctcatcatcatcctcaaaatacacatcaaccgtattgaacatacccacctcatcatcctttgactcatcggatatgacaacggcagtcttaatcatcttctcaaggtatctgatacggctctcgttctggttcttaaactgcttggcggccttgtactcgaagttctcgctcaagtcaccctgggctctcgccacctttacgtcatcaagagccttctttctgacaacgagctttctgtactctatctcgtcctccattttctttatatcatttgctgtcaattcatcatgcatgtcttaaaccctcttcctgcaaaattgcgtcaaaatgtatttagagaagccctgcgataccacaaagcagcacaatcgcaccaagaactatacggtaccatccaaacacaataaagttatgcttctttatgtagcccatcaggaatttgataacaataagtgaaacgacaaatgccacaatcatgccgataatcagaatagcagcctcttcccctgtaaaatgaaatccaaatttaacaagcttcagaagactcgcaccaaacataaccggaatagcaaggaaaaatgtatactcagcggcaacagtccttgaaacaccaattaagagagctccgacaatagtagcgcctgaacgtgatgtacccggaaaaacagctgcaataagctggaaaaatccaatcataagcgcagtcgtgtagcttatgtcgacaagtgaattaatcttggcagacttgccattatgtctggtctcaatcacaataaaagcgataccaaagagtataagcatgatagctactgtctggaaattgtaaaacagtctctcgaatacatcatcaaaaagaattccgataatagctgccggaacagttgaaacaagaatatgaaaccacagcacgaagatatcagtcttgacccatgcaccgatacctgtctttgcaagaggagctttgttattcttcctgccgaatggccagatctggctccaaaacaaaacaacaaccgccaaaatggctccaagctggataaccacctcaaacatactgtaaaaatcgtccgggttctttcctattctaagtggtaaaatctcattcaaaagaatcatgtggccggtgctgctgataggcagccactctgtaatgccctccacaattccaaatataacagacttgataatgtcaaagatttccataaataaatttccttcctttaagatattttctacaattaatttattatattatttttccaatcacaagtccatggaatttaagaaaaatttaaattaaatcttttcatattagaaaattttttgtaaaatactcatagcaattatgaaaaagtgaaaggacaaagacaaaacatgaagaaaaaaatcagtatcatgctttgcatagtactcttcgccctgacaggctgcaccaactccggccgcacaatacgcttcggagcagccgatgttggcggaatgtactattcatttgcaaatacatttacggagcttgccaatgaacagggctatgactttacctgcaaggtccgtaccacagctggctctaatgccaatataaggcttttatccgatggctatatagagataggcattgcacaggcagacctgatagccgccgcctacaagacaaatgaagatttaagggctatagcagggctttacaccgagacctgtcagcttgtggtccgcgctgattcagacatacagactcttgacgacctgtcaggacacactgtaagcatcggagctaaggaatccggtaccgagcgaaatgccacacagattcttgagttcgccggtatgccatcatcccttgttgccaccaaaaacctggactatatcgaggccacaaaagagctaaaagccggtgatatagatgccttcttctgcactgccggactcaccaccactgtcatagatgagctctcaaaggaatgcgacataaggcttatcccgctgacagacactgtgataagcaagatgcttgaaagcagctctgcctacacaagcgaggtcatacctgccggcacatacacaggccagaccacagatataagcactataggtgtaaaatcagtgcttatcacaaagtctgatgtatccgatgatacaattgagcagcttacatcgctcctgtttgaaaaagaaaatgagctctcctactccaactctcttaagcttgagctgacatatgactttgcaacagacggtatacctattccattccacaatggagcgaaaaggtattatgaagcctgcggatatagcacaaattaattcgcgaattaattttcggcctattacgtaatgttctaaaatataaaagaaaataacaagaatataatcaattaaaattgaaaggtaacacatgaaaatacaacttgacatgtaccagacactggccgttgccgtgcttgtactactacttggaaactatttaaaaaagaaaatatatttccttcagaaattctgtattccggcgcctgtcataggcggactgatttttgccatcatgacatgcatatgctatgtcacaggaatcgcagaattttcctttgatgacacactgcgcgaagtctgcatggtattcttctttacatctgtaggctttcaggcaaatctcaaggtgttaaaaagcggaggcaaatcgctcatcgtattcctgggactggttatagtgcttataatattacaaaacctaaccgccgtggggcttgcaaagctcttaaacctgaatcctctaatcggcatgtgcaccggctctatccctatggtaggcggacacggcaccgcaggagcctttggcccggtgcttgaggacttgaacataaagggcgcgacgaccatctgtactgcagcagctaccttcggtctcatctttggaagcctgataggcggacctcttggaaaaagactgattgaaaagcatagcctgcttaatacagcagcaaacgaggatgacagcctgctggtggaggatgagaaaaagcatgagcgccacactaatatgtatgctgatgccgtattccagctcatcctggcaataggtgtcggaaccatctttacaatgctgctcacaaagacagggctcaccttcccaatatatataggagcgatgctcgcagccgcactcatgcgaaacatatgtgagtacacaggaatcgccaccatccatatgggagagataaatgacctgggaggtataagcctctctctattcctaggcatggcaatgattacactaaggctctgggagcttgcatcactcgctctcccgctcttcatactgcttgcagcacaggtgcttctcataatcatattcacgtatgttatcgagttcaacatcatggggcgcgactacgatgcagccatacttgtgtcaggcacctgcggcttcggaaccggagccaccccaaatgccatggcaaatatgcaggctgtctgcgaccaatatgtgccatccatcaaggcatatctgctcataccgcttgtcgggagcctgtttgctgactttttgaacagccttgtaatcacattctttataaacttactgtaaaacaaccggagaaaaatatgtttgaaaaactgaaaaaaatatttaaaaacagagacgaaaaagaaaaacataattacgatttaacttttgacaacgtggcaatacctgaggtgcacgtaaaaagcaccgaaagtcacgaggacacagataaagaaaatgcacctatcagctatgacaatgttgccatacctgaggtgcatatcagaaacagaaaaaataaataaactaaaactccatatgccttttgccctttcacaaagctcctatccttccctgcttattgtccttattctgccttctcaacagatattatctttccctcaaacggatccacctctgaaatagttccggtatattttacagtcaccttatctccgcttgcaacaccctcaagtccgtcaggcttctcatcgaagttaaagctgtatggtgtatccttgtcatcagtcactacaaacatgaagtcctttatgtcatcgattgttcctgtaagctccttctcttcctgtgagcccttttcgccttcatccttggtatcagcctgctttgcattttcagtgccagctgcattatcctgctttgtatcgctctgtccgcagcctgcaaacaatccggcgcaaagcatagctcctattacaattgtaatcagttttttcttcattatgatatacctctttctttatttataagcactactatgagtacgttttctaaagagtactcttctatccacctaaagtaaatagaatacataaaatattaaagaaatcttacgaattactgcttttttgagcctcttgcgagccttgcaggataccatttttcaaaccatccggtaaatatgcccatcaatacaggcatcagattgtttacgacaataagtgtagctccaacacctgcctttttcagcagaaatgtccacactgctgtcaacacgtataatactccccatgccgccgcaagtatataattcgtcttcataaagagaggatttttatgtgcgtcttcaccgccataattgtatttcacatatgttgcgcataaaggctcctttgtcaggcatgaaaccagccagaacagcccaaacaccagatatccgatatctgttgatatgtcacctgctcctgtcaggcttgcaatcgcagaaagtacagcaacagcaacaattgagagctgatcccatattacaaatttatgttttctcataataaaaggtatagcggatgccaccaaaagagcaatcacagaacccttttcagtattgacagaaactgctatccaaaacgtaatccatggtatgagcattgtcatcatggatggatttttctgtacctccacaccttgtgatgttttttctgcctctttgactgccgatgtacttccaaaaaatttatcccagtttaccatcaaggaaaaatcacctgtcaccgtatacatctgctttcccaatgcctctgcgccacctatctcgcctcgggaaatagccgaccataccgtaaaaggcgtatctatgcgtgtagtcgcggcaaggctttggtcagtaagcacctcactacctttatcatcaagctttatctgatatgtatgcttcaaatcggtatagcatatctcaagcacacgttcctttccatcataggcatccttattgtataatgctgccatctgtctggtgaaaacaaggtcatccgcttccttttctcctgttatcctgctgattccccagctggcatccgccatactttcaaatacatcccttggatataaaagagtatggagcgccgcttctgttttttcagatatttttcctgtgatggcatattctgccccggcactttttaccgtagccagatattcgtcagtcctctttgacagctcttttacacgaaacagctcaccctgaccacaaaatatggttgtataatgcccttttccaaggaaatggtcaaacatccgaagtacactgtcataattttcctctgcagaataaaagccacaggtagagattagcacatgccttttgccttccatgtcatatctgcaatcatggctgccgcttccgtatccgtcatcctttgtactcataaacggcaggctcatgggaagctgcctgtcaatcacgttctttagtattcccggcacactaaaatagtacagaggaaacgaccacacaacaatatccgcttcaagcattttcccaataacagtctgcatatcgtcatttatgcagcacacccccggtgtcttctgccagcatgcaaagcagcccttacacgctcctacattcattgaggctacatgcatttcatcaatggatatagcttcatttttgctcttatatccttctttgaaaccttctataaagctgtttgcaagccttaacgaattgcttcgtttgccttttggacttccgttaatcagaagtatgttcatgctttatgccctcctgtaagtatatagttaattttagtatagcggattgacaggcaaaaaacaattaaagtttagacttagaaacaataccataattatacattcaaaatacattcaaattcttaaatatgccttgtaattataatactatgatattaaaatagagctatattatttcaaatcaggagaattcatatgggttacgatgaaaaaatttttaaagcaaaggcgaatatcaaggcccgcagattatggcttgtttttgctattctgctgaccgcaaattatggtaccgacacagcaaatggcgcttattctgtcagcaattatatcatttttgttattttatgctggctgcctttcgtgtgtggtgacatacttctaaaaaggaaggggaaggataatgatcattacaggcttgcatttgtcatcggatatggtattttttacgtatttcttttgtgtacgacaacctcaccgattgcattcacctacatacttccgataatcagccttattgtaatatttaaggatgaaaaattcatgatttactgcgccgttgcaaatatgctaagccttatagcaagtattgcatttcacatatttgtgctgggtcagaacactgctgtagaccacaaaaactatcagcttcagatagcatgtcttttactttgctacataggctatatcatgtccgtacgtcacctgactgagtccgatgctgcactcaccgagagcataaagtctgatttgaatcgcgttgtcacgacagttgagcaggttaaaaccgcttgcaacactataatggacggtataaccgtggtccgtgagcttgcttctgaaaacaagcatggctcagatgttgtcgttgagggaatgaataagcttaccggaaataacaagcatcttcagtcccacactgcttcttcccaggaaatgactaccgatataagttcacaggttgagaatgttgcagccatgataaatgatatggtttccctgacaaccgaatcaggcaagcatgccaaggtcagctctgaggaccttgaaggtcttgcccagacaacaaaaaccatgtcagagctttctacagaggttgaaaacatcctgactacattcagagatgaatttgagatggttaaaaatgaaaccggaacaattgataatatttcaaaccagacaaacctcctcgctcttaacgcttctatcgaggctgctcgtgcaggcgaagcaggtaagggatttgctgttgttgccgaacagatccgtacattaagcactgagacaagaaattcatccggtcagatcagcgaggcgctctcacggcttgacgagatttccggaaagatgacctcatccattgaagaaacgctccgcctcatccagctcactcttgaaaaggtaatgcagaccggtgaaaatgtagagaagatcacaaaggattccaataagctcggaagccatatccgtgaaatcgatgccgcaatgcaggaggttgaagcatctaaccagcagcttgtcgacaatatggaaaaggtatctgacatcgtagaaaccatgacctcatgtatcggtgcatctgacgcgataagccgcaagatgctcagtaaatatgatgaaagtgcaacaaatatcaataatatcgagactgttatccaatctctcatgcacgagctcggagttggtggatttatgggacttgatgatatccgcccgggtatgaaggccaaagtgatcctgacagatgtacagaccggcaacgaattccattgcgaagtaaaggctgttgacgaaaacggtcttaagcttgtatcaggcggcttatctgtagactcatccagaccttgcaatctgtatgttacagttggcaatgtaatgtactgctggaaggatctcacaatcacagatgaccttatgataacagtcaatacgcagcctgaaatcttgaaccgtaggaaataccctcgcatggatttatcaaacaattgcactatcaagcttaaaggaaccgacactacattcaaaggaactcttgacaatataagtgcaaacggctttgcatttttgacaaaggatccttatttcgtggatcataaaggagcgaaggttactatctcgatagaggactttgcgcttgctgaccactcagtattggatggatatgtaattcgctgctcaaataatgagggaacatatatcgttggctgccagatgcctgaggataattattatatccagacatatgtcaatgaacagcttcgtgctcactcataaaaataaaagctatgaaagcctttaaccgggctctcatagcttttttgattgataatcttctatcctattatcttctatctattatctttatcttctatctgcatgatgttttttcctctctggactctcatatatacattgtagctgtgaatgctgaatattatgatacctagcaatgcacaggtaatcacaattgtacggatgttcttcttttttataatcataaatgtgttctccataccttagtacctacatcgtatctgtgcttcgttctctattcatatcacatatacttgtatttctagtaccaattatacaacatatagtgcctacaatctatactcttggcgcgaaatgtcgttttcagggtgtgaaatgcagattggcaataaaaaacaagggaaagtattaaatactttcccttgtaaaatcttacatatagacttttaaattagaacctttgtctattttgcctgctctgcgatagcagcctgtgctgcagcaagacgagcgattggtacacggaatggtgaacatgaaacatagtcaagtccaatcttgtggcagaactcaactgatgaaggatctccaccgtgctctccacagataccaacgtgaaggttaggattaactggctttccaagcttaatagctgtctccattaatttaccaacacctgtctggtcaagcttagcaaatggatcgttctcgaagatcttgttgtcatagtaagcgttaaggaacttacctgcatcatcacgagagaatccgaatgtcatctgtgtaaggtcgtttgtaccgaagcagaagaaatcagcctctgtagcgatctcatcagctgtaagagcagctcttggaatctcgatcattgtacctacatggtacttgatgtcagcatttgcagcagcgatctcagcgtcagctgtctcaaccacaatcttcttaacgaacttaagctctttgatctcacatactaatgggatcatgatctcaggctcgatatcccagtctggatgagctttctttacattgatagctgcacgaataacagcctttgtctgcatcttagcaatctcaggatatgtaactgcaagacggcatcctctgtgacccatcattgggttgaactcatggagtgactcacagatagctttgatttcctctactgacttgttcttagcctttgcaagcttctcaatgtcagcctcctctgtaggaacgaactcatgaagaggtggatcaaggaaacgaattgttactggacatccctcaagagcctcgtataatttctcgaaatctccctgctgatatggaagaatcttgttaagagctgtctctctctcctctactgtatcagagcagatcatctcacggaatgcagcgattctctctggatcgaagaacatatgctctgtacggcaaagtccgattccctctgcaccaagctcacgagccttcttagcatctgcaggagtatctgcatttgtacgaaccttaagtcttctgaactcatcagcccatgccataacacgtccgaactcaccagcgattgaagcatcaactgttgggatgattccagcgtagatgttacctgttgtaccatcgatagaaatctcagatccctctgtgaatgtctgtcctgcaagtgtgaacttcttgttctcctcgtccatattgatatcaccacaaccagatacacagcatgttcccataccacgtgcaactacggctgcgtgagatgtcataccaccacgaactgtaaggataccctgagcagccttcattcctgtgatgtcctctggagatgtctcaagacgtacaagtacgactttctctcctctttcagcccatgcctcagcatcgtcagctgtgaatacaaccttaccacaagcagctcccggagatgctccaagaccctttccaagtggagttgcagccttaagtgcagcagcatcgaactgtggatgtaataatgtatcaaggttacgagggtcgatcattgcaacagcctcagctggtgtcttatgtccctcatctactaaatcgcaagcgatcttaagagcagctggagctgttctcttaccattacggcactgaagcatatagagcttcttgttctcaactgtgaactccatatcctgcatatcatggtagtgattctcaagagtctcacaaaccttaaggaactcagcgtatgcctctgggaactcctgctccatctgagcgattggcattggagtacgaacaccggcaacaacgtcctcaccctgtgcattgataaggaactcacccataagcttgttctcaccagttgcaggatcacgtgtgaatgcaacacctgtacctgactcgttatttaagttaccgaataccattggcattacgttaacagctgttccccatgaataagggatatcgttatctcttctataaacatttgcacgtgggttgtcccatgaacggaatacagcctcgatagcaagctttaactgctctacaggatctgaagggaaatctgatcctaactgattcttgtactcagccttgaactgctctgctaactctttgaggtcagctgctgtaaggtctacgtcaaatttaacacctctgtcctctttcatcttgtcgatgagctgctcgaagtatttctttcctacttccataacaacgtctgagaacatctggatgaaacgtctgtatgaatcatatacgaaacgctcgaatgctggatctgggttaccagcgatcatagctgcaacaacatcatcattaagaccaaggttaaggattgtatccatcatacctggcattgaagctctggcacctgaacgaacagatacgagaagaggattcttaaggtcaccgaatttctttccgttaacctcttccatccattttacaccttccatagtctgagccataatctcatcattgatcttacgtccatcctcgtagtactgtgtacaagcctctgtagtgattgtgaaaccctgtggtacaggaagtccaatctctgtcatctcagcgaggttagcacccttaccaccgagaagattacgcatggtcatgttaccctctttgaaggtatatacccacttgtttgccattttgcaattcctcctaaattttatttctggtatggtaaaaaaaaccatccatatacttgattaatgtgtgcactcatacaagcgcacacattaataataccataatttcagcaaatatcaactaatttttattatcttttcccttatgtttcatactatttttttgaacacggacagacttaacattctttactatgacaaatatcataattgcaagaattgcaactatcccaagcgcaccaatagtcagcggaacggccattccactctcactgatcatggtggcaagcggtacctgctcatctgctatatcatgcttattgtcgtttgccgcctgcggtacctgctcatctgctatatcagtatttggctgtgcctgcggtgcctggattccatcctgcggatcattctgtccgtcaggcactattgtgtttgcggcatttgctccatctgcagctccgttatttgccgctcctgcggcattgcccgctgcattggctgccccggctgcatttgcagctcctgcggctgcctgattgccgcctgccgcagtattgtcatttgctccatttccggcagcagccatgcttgatgcagcccttgaatatacaaagttgaacacgttttctgacgcatttgacgacagctttcctgtctgattatagctgtccggaatatatccatctatatacagatatgctataaccggcttatcgcccacattaccataataggtacggctttctgcaagcttattgccatctgtatccacatagttgactgtatactcagcaagctcgcccggtatgccatatgcaacaacatagtcctgatctcccgatacgagaaaagccgactgtgcaaccgtattattgtcacggccgcttaatctgattccctttacgtagtacttgctgttttcattaagtgccacactgccctgtgcatcacagctgatgacatctccatattcaagacctgtgacaattattttgtctcctttagcagaaacagaaaccgaagcctcattgcctgatgccttgcgcacctgcacaccaccgtttatgcttccctgacctccggctgagaaggaaacagtgtatgtatatgaaaatgcctttgcatctgctgtctgtgagaaaacaccggttatgacaacaagagctgcaagaaaatatttaagcaatcttttcattttgcttagccccctttctgtcacttacgaaagccagtatcatcaaaataataccaatcacaaacactacagctgacgctattgaccagatatctccggtctttaccttgcttgttgtagttataaatgtaggtggatttgataaagttggatcagagttatcctctaccgcaaagttcatcataagcttcgcgagtgtatcctgatatatattaccctgactttctccgtcaagccctactaaaagcttcacactgcctccctctccaggctctaatgtctttaaataaaagaacttatccagagagtttgtagcctcattgagtccttttccggctgttgtctccttctcaccacctacactggtgctgctgtatatagtgtcctcttttccatccggtcctacgaaagtaagaatatatgagtatccaccattttcagccacagtctgtgtatcctcaagactctttaatacatcattggacatataccatttcgtcgaaatactgctgttattctttatatcaacggaaaatgtgacagaatctcccggctccatctgtgagacagaggctgctattttatttgaatcgaacgaactgaccatttccttgccggtaaactcacatgagccggctgtagtagtattctcatctgcaaatacagtgcctatcgaaccaaggataaacaacatgcatgataataatgcgataaattttttcatattgtcctcctttactctaagctaagttccccgtcatctgatatatttacatcaacaccccacgcactcttaattgcgtcctttgcattgtgtgtctgtactgcatcaacagttgcctccagcacaaattgcgcaccatcatattcataggtagtagtgatggttgtaagtccgttatcatcagtctgtgatgtctgacccacaatggttgcaatatcgccggatatactgattttgtctgtaaaatcagatgaagtctgaccctttttcaaaatagaattatagtaaaatacatttctctctgtagtctcagcactcttatcctctgtccagccatcgtttgtaaagtcaatctgtatctgtgatggatcaaggtttgaaagcttatcaccggtctccttgtctgcccagtaatgctgcacagtcactctcacatactcatctatcgagccgctgtttttgacagcaagcttctcatcgtactttttgtcgagaatcagtttttcatctccagcattctttagcatatctccaagcagcactcctgttgcctcgctccagtcatcatccttatgcttataatcacgccagctcacatcattgccattctcagtcaaagtaacaccgatggatttgatgtcaatctgagccagataattatcactcatatatgtaagagtcgcttttgtagatccaatcgtcgatgctgcaagcattatcgcagaggatgctacaagtataattggaagttttctcttcattactcttcgccctcctctttatcatattgtgctgtcgcatcccattttgcatcaggtgcgacacacggattgcccttctcatcatatgtgacaggagcacactcctgaaccacaactacattgaagctggtctttaccttttcactaactgtgatagctgcaacaatcggctcggttttgccaccaaccggcactacctgactgtaataccagtagccatcatctgaaaggctccagtttgagcctgatgcctgtatatcaaactggcttgctgcaattacctttaccctgacaaaacagtctgcttttcctgtattctcaatctcaatagttttcttccagtccttaaacttctccttgacatcagttgtaggaccgatatctactgagataccgccctttgccgtagcataggttgtaaaatatgccagtgtcggtttaactgaaacaccacagacaatgagtgttgcagcaaaggctgcacatacaagaatacggtgatttctattaatttttttacaagactctgataattttttcattaattctgcacccattcccatccggttccgtcatactcaaaatggtttacgacaccggtactataaatcaatttgtcgttgtaatcgtttgtgaaatcaacatctgcggtctcaccggccacaatctgtgtctctatgctgtctgaggaggtcacctgataactgccagcggcatatacctcctttactatcacccttgaccctgccggaatattgtcaataactacgctcttagcccctgtactgtcaaatctgattgatgcgatatcggaaaacaccacattaccatccctgtcgtaggcctcaacatcaaatgcaaacaccggctcaccgagtgctgtattgtatgtctttaatgtcttattaatctgtaagcttcccataagcccggtctgttcaggcttcagctcgatatcgatatcatcatatatccatgaatctgagccgcttcctgtcatagcaaactcattattcggagccgaaatcagatacggcacaaatgtgtatccaaatcttgccgaattagccggctttgcatacaccagatacagtcccgtcttaacgcctgtgacgtttccccttccgtttgaaacatctattgcctcatctgctgtcaaagaacctttgtctgcaatgtccgcagctgtctttgccatcttttcccagtcatctgcggtagttttactgctgatatctgatatagatttagccagctcatcaaactgcttcgttgcagtgtatacatcgttctcatctacatctgccactctgtaaagctctacgggaaaatccacagtatacaaatcctcccatgtatcagggatatcaactgttatagagcatttcttatcaatatcaatatgcgtccttgcaaaaatgcttccacatggcagagaaaacaaggctatcgctgctatagctatactgacagctctttttaaactattgtgcatttttcctccttactgattctatctgaatctatacaatatcgttttactaagtatcttacaaattataatatacaaaaccagaaacagaatgccaagcactatggcttcatgtaacggctgtacctgctttacatcctcgacaataagtccctgtgcatcatttgcaatcctgtgccccctgataagaagcctgtgtgaattcacaccatacggtgtacatgtgataagtgtacagtaatcctgaccttcctcaatctttaagtcattaagctcatcaggcaaaacaatccttatctgatcaacctcgtaggtcagtgtctcgccaagcacatacagcttaaatgtgtccccctccgccatctggtcaatatccgtaaatagcttagacgacgtaagtcccctgtgtcctgaaacagcacaatgtgtgcttgctccgccaaccggaagcgatgtgccctcgatatggccaacacctatctgaagtattgtattgtctgtgccgtggtaaatcggcaatgagacattgatggacggaatctcaacatagcccatgactcctgtgccagatacatcaagaagactttcatactctgctttatcctgatctgacatttcataacgatcctgcttacttaaaagcttctcattatatgcctgtgcagcttttcgcatctcatcaagcttttgctcatccgtgttgtctaccgcatcaacgtagcttgcaatggctctggactgatgaaatgaattccaataatcacttactgtcggatatagcagtaaggacaaccctgcgataaacactacgccaaaaagaatagtagataaacgtcttttcatagtgctctccttactgttacataaactctaaataaaatctattatagctgccacagatttataacctgtggcagcataatatttaaaactaaatagtgccagtcagatattaattatctaacacgcttctttgttacaagaacaattccaccaccgataactaagatagcaccaattacgtagattgctacacgtccggcaccaccagttgaaggaagaactgaacccttgttgtttactacatttgtagataactcacccttatcaagcttaacacctaaatcaataattgaaccagatgctacatctcctgtaagatctgtaagcgttggattatcactagactcgtcatgctttgcagaaattgtaaatgtctgatcctcgattgagttgtatccgtcaggtgtctttgtctcgcgtaatacgtatgtaccatcatctaagcctgtgaatccgaatactgttccctctgtattagtagaaagaatcttcttaacctctacaagcttaagctcctcttgtccgtcaacctttactttcttgaaaagtgagaactctgcacctgtaagtggcttattatctttgtcaaccttgtttacagttaacttgtaagtaaatacgataaccttgtcttcaggagtcgtacctctgtctccctcaccaccattgttagggttgttagagaacttaagactaactttatttgggtttccggctgcgccgattaccgcattctcgttaagctttgctgtatactcaacaacaatctgatctgagtttttagcgccaaatgctaagatattgtcacatgtaaatgtaagtgtcttagctgttgcatcatagctaggtgtgaaataatctgtaacatccttctcacctaatttaattactgcatcattgttgtagtcaagtccttttgaaagagtatcatcaaactcgagagagtatgccttgtagctttcaatgttgtttgctaatgtagctgtgagctggaatggaacatcatctccgatatcgtaatcggctgaatcctgccaatctgttgtcacgcctgttgtgtcgtttgtatccttaaccttcttctctacagaaggaacatctgcctttacatttgcaactacatcatctgtaatatgaagaatgaactctgtgtaagattcctgaccctgtaaagaattatcctgatctttgataaggtagtaacctggcttaaggttgctgattacattctttgcatccggatctgttactgtaactgagcctgatgctgatgctaagtttgcaccaataatctgcgcctgctctttaagctctgaagagttgttaccaaaaccaccgagtttttcagcataactagcagcatcaccgccgagagcagtctgtcctgcttctgtaatgccctctccccactttatgttagaaagagttgctttatctgctgataaatcaccagataaaatctgataagcctcataagtgtgtcctttgacagccttgttaagtgtaagactgaatgtgttttgatctgcgtttggtgctgcaaatacagttacactcattgcaagtgtaagaatcatagcaagcactaatgcaatgcttcgtttgattgttttcatttcgcattctcctttttttataatactttttgttttttatagaaaagtgttattgtagctatcgcaataagcacaactccacttaacatatacaaccatctgttaccgcttccacctgtttcaggaagcttatactcattgagcttatttgtaatctcaatagtacctgagtcaacagccatattctttcccggtgccacattggcatcagttctgttaatcactgttccatctgtattcttaaatacataagaaacatcatagcctgacatactgttgttctgatttattccaacctctgtaacataatacttataggtttcgcctgttatatgacctatattatctgtctttttcgtaggaaggtctttgaatttataagaccagtttccatctttatccggtgtcacttctacggtatcaccgtatttatcatcatttcctgatgaatccacccgatgtaactgtaaataaatacttccatctgtcttatttataggtttgttattggaatcaacccaatttttttcaacagaaatttctgttgttggaatagtctcatcaccgatatatactatatcataattgtttgccagacattttcctgttaagctgttatttggagctgccacaggatatttatctttatccagcgaactaaagtagaaatatgttttttccggttcttctggaagaacatagccactaggagcctttgtctcaacaacataatactgtgtgttatatgtcattgaatttttattaaagacaatctctatcttacctttatcatcggtaacatatttattaacatagacatatccttctggtgttttcgtagtatctgtactgtttggatcatatttgtaaacatcaaactctgcattcggcaataactttccgttatttccctcttctgtcttataaagaataaacgaattattcttatatacataaaacgaagaataagatttagtgtactctaattgagtgttaatatctgttttactattatcaacaccttccagtgaaacggcattagatacattaaatttaggttttgaatcattatactcctgtagcaaatcaccctttacactataagtgtatgtcaacattatagcttttccatcagggacaatagcatttattgttttgcttgaatactcccattcatttgatgcttcctgtgaatcatatgtccatttacagtcagatatcacctcaccaggtttgtatgttccatcgtcctgcttgatagcctctctgaacttaactgtaccaggcatcaaatccacctgccagcttaccctagcattttcataagttatttttttgtacgacaaaacatcttttaaatttaatggcctaccaccatccagatatgtcttgccctccggatttataagaacagtataattcaacttatgttcatcatcattccagcttccgtttttgcttataactttatctcctgaatccggaatattttcattatcctgctttggttttgatattatctgtgtctggctagattcaccaatcttatcattattgtccgatttagcagaagctgtattcttgtacacaagctcctttcctgcctccagggtttcagcactatcagccttacatttgtaaacaaggaaaattttagaaccttctccccagccacgaacctctgcatcttttggcttttctacagttgtagttattacctcacgaccattgcttgtatcttttttacatgaagtattaattccctcagaatagtaatttttgccatttaaattttctactttatagctcttgccatccaatgtagggtatgtaaaaccttggtctgaattattgtattttaactttacagtaacattttgtacgctgatgccctccggcatattatcagtgattgtatatttggttgcatttttatccattgtaaccattacaatccatgtgagcgttccgtcatatcctgaatcagtggtctttacatatgtatctgctgtattgttatttccatcactcttaacaattgatgatttaatatcttttgtcgttttaaaagagtcatttgcattaacattccagaaatttacgttgttcttaaactcgagttcgccacctgctgaatagtctgcatatgatttatattttaaagttactttataaccatctttattgctattagaaggtacaaacttatctttaaactcaaacgaaaatctggtaaacttagcatccgtttcgctattaagagaataaaaatcatactcatgatcgccggattttactttaaaattatatatcgtatcgccaaaaatgttttttgccttatcaaatacatctttaacctgctgataagtcatataatgagccgtattgtctgaagtattatttgtcagttcatcaacaaaccaagcccctgcatccgctccggttgaaggaatggtaaatgtcgattcccaactgagctcatacctgttattctcagtctcttcattatgggcagtcaagttctttgtaacttttacatctctatgagttcccggaacatttactccggcccatttgctaaacgatatctctttgttattgaaattaacctgattattaacaggctggtcatagctttgtggtgtgacagatgtttcatatgtaataacatatgtactgtcatttttattatctatagccacaaagttaataccgctaatcttgccttctttgtccttttggatttcagcacctttacagtcggtatcctgttcagagcttattttaaaattctttgcatccttaaggcagttatctgtcagtacagccccaacaatatcatttctttctttattaacagtgattgtccacttgacagtctgactgtctgagtcgtatgcacctgttttatcaagatcatctctcgtgtatttaataacactgcttgatgtatcaataaccttttcattagactttttatttattgattcaccggtaaccttgttagacgcctgtgactcatttccactatcgcaaagagatgtgtcataataatacttgtattttatctggcagctttcaccggcattaagcttaggcagcgttgctgtaagattatatttatgattattattgtcattattcgaagaagccgtaacattagcagtatattcaccaccaacctgctgtccgtttttagttattgtgtaagtaaactttgatgtatcaacagacattttgccggcctccaacacatcatttaaagtaataacatccggtgtacctttttcagatgaaacatcaacaacatactcagcatatttgccattgtcatctttcttaagcgtattatctgttgtatttgactttttaacggtaatatcataattagcgctgtggttcttatcccaatggatatattccttgcttatatctaatgtagcatctccgcctatcttaacaacaacatcaccattgtccttaacttcactatagccacttgcgccaaatgtcgcaccacctttaatttcagtagtgttgctttgtatgtaatcatcagcaaatttaatcaatacagaaaatgtaccatcattgttttttataaagcgataattacaaaacttattgccgctttcgtctgtatatgaatgccagccatcacaaaccgcatcaggaatagatatatcctgtccataagtcatataataattcttaattatatttccgctttcatccttgaactcaccctcgcctatggcgaaagacatatcaaccttataattaaatgtctttccatcccattctacttcaggctgatcaccttcaagcttcaccaccggaggatttttaagcttccccagattggtatatgtttccttctgtccatccacctcgaactcgtacttgttctgatcttctgcagatgcaggttgtataagtctgtacgcagtaatgcccagcacaataacagccattgaaataataaacgtagcaagctgtctacgtcttctcactcttttaagccgttctttgccgagacgttccatatccttatccattctgcatcctcctttcatagagttatataattccatttgcttaatatcttaatcgttattttacagctaacatattacacctttttggtcacacagcggtcacacgggaccataaatctgatttttctacttttttactaaaaaaagctaaatatttttagtcaactttgccaattttagacaatggccatatggcaaatgtaattctgccgactacctgctcctctgagacacagcctatagctgtatttcttgagtcaagtgatacgcttctgttatcgcccatcacgaaaatcttggattcaggaacctgataaggcagctctatattacagtctcctaaagctttttcattgagatacggttcatcaattgcgatatcgtttacataaaccgtgccatcctctgatatattgacccagtcacccggcatcgcaataactctttttacaagtatcttgttattgtaataaaaagctatgacatctcctgttttaaagtcatgcccctttgatgccataagcacctgtccctcctgtaacgtcggtgacatagatgttccggtcaccttcaaaataggaagccacaggtttgcgaccaatattgctgccgctgccactaccacaagtgttcctacggtattgaagagtgttgctgcaaatttgttgttatacttcactcttctcagttcctgacgcagctcctttatgccaagatcatcgctataacggtcatagtcgtctgtcatgatactgcgatagcccgatgtatcttcagtcttctcagcacttttattctcaatttctttattctctactctgttttcttctgaagccttccttgatatttccttttctatatgtacagatatatcctccggccggttttcttttttagtctgctgaaattccttctctatttcaatatttttttctatatcaggagttatgtctggcgccggtgttacatatttaaccggaattatttccgctatttcctgtgatatattttcatcaacattttgggtctgcttatgtacctgcgttactttttcagatgacttaacagatgtttccatcatctgtgccaaaagtaaatcaagcttatcctcattggtaagtggtttctgttcgacatccttcagctcctcgtctttgcttaaatccactacatcaatattatttttgctttctgcaacagctgcaatattgttatgattaatctctgcaactacctttttattgtattcagcatctgtgcagctttttgtcgaatttgtgaggttagctgatttattctgcttaattttcttctgttctcttttttttcttagctcaatgtactttacggcaactcttgccagagcatatattgcctttttatatattttttctatcattcttttgtccaataatccatttcataaccacaaaatattgcttctatattattttcttgtcagattatttgaagccatggatattacggcggcaaatttctggatttcctctgttgctgacgtgagtttattaattgcagcattgatatcaccagatgtctttacctcacgctcaagtgtctgaatatgtttttttgtctcgtcaagctcttttcttaagtgttcaacctctttacttctgtctaaaagcatctctagcagctcacttctgctcagcttctttaattcttttgcttccatattcataatctccatatatcagaacaaccaaagaatagcttactatatctttggttgtcatttgtcatctatattatatcataaaatttgatttctgatatgtttttatattaatttttgtgacctaattcctaattttgtatgatttcacaaaatacactttcaaaaaaagttgtaattgcttttttttagcctcatttaacaaaaaatatcgttagtttgtacaaaactagaattcaaatttctttgcaaaataagcatcaagctcatcaattgcgatacgctcctgctccattgtgtcacggtcacgtactgtcacacaatggtcttcctctgagtcgaaatcatatgtcacgcagaatggtgttccgatttcatcctgacgacgatatctctttccgattgttcctctgtcgtcatactcacagttgtatgtctttgaaagctgtgcaaataccttttcagcactctcattgagcttctttgacagcggaagtactccaatctttacaggtgcaagtgctggatggaaatggaatactgttctgacatccggcttctccggtgtaccgatatcctcctcatcataagctgcgcaaaggaaggcaagtactacacggtctgcaccgagtgatggctcgataacgtatggcagatatttctcattcttctggtcatcgaagtatgtaagatcctgtcctgaaacttcctgatgacgtccgaggtcataatctgtacgatcagcaatgccccaaagctcgccccatccgaatgggaataagaactcgatatctgtagttccctttgagtagaaggccaactctgcaggatcatggtcacgcagtctcatctcatcctccttgattccaagggaaatgagccagtcacggcagaagcctctccaatacttaaaccactcaagatctgttccaggctcgcagaaaaactcaagctccatctgctcgaactcacgtgttctgaaggtgaagttaccaggtgtaatctcgttacggaatgacttaccaacctgtccgataccgaatggaatctttttacgtgatgtacgctgtacatttttaaagtttacaaagataccctgtgcggtctccggacgaagatatactgtattcttagcatcctctgtaacaccctggaaggttttgaacatgaggttgaactgtctgatatctgtgaaattgtgcttgccgcatgatggacatggaacattgtgctcattgatgaaatctaccatctgctcgtttgtccagccatcaactgatgtctcaagctcaataccattgtcctgtgcaaaatcctcaatgattttatctgctctgaatcgctcgtggcactccttacaatccataagcggatctgagaagccgccgagatgtcctgatgcaacccatgtctgaggattcatgaggatggcacagtccacacctacattataaggattctcctggataaatttcttccaccatgctctttttacgttgtttttaagctctacgcccaggtttccataatcccatgtatttgcaagacctccgtaaatttctgagcccggatatacaaatcctctcgcttttgctacctgtacgattttgtccatggtcttttccataattcttgtttcctctctatcttacttatgatttatttgtattcgtaactgttcagtaccttcacagctgaaagctgcaggcgcattagaatcagctgtactgaatagttacttgtattcttaattataattaaataacaattcacgccttaatctacttatatataacatatgtgatatatgacaccggcgccgaattgtcctcctcactgtcaaagtcaaatgtgacctcgttatcctgcttgaccgagtttaatatatcatcatcactgacactatcatccgctccgttttcagttgcttccgtcgcatcggcttttactgcttctgtgctctctgtggcactctctgtccctgtggtttgtgatgcaagcaggctgtacttgtcaccaatcgcaactgttttgtcatctacaagctttactttgtcgacagatgcatataatattttccctttcacgtgcaaatttgagctgccttcgtaaacaacgaccttatagccggtttcatccagaaactcagatgattcacatttctttgccttgccatcatctatcgccgcgaaatcggtcttgaagtcatatccggctgccagagcctccgcaatcgtccctgaaaaaagctttgtcccattgaaatcagtgtattcatcggttgacgcatagctcatggtaagagatgccttctttttctcgacagtcagctttttgagtttgatcgaaccgtcattcttcttattgtagtcgtctattgacttgtccacatagctttgtaagtcatcctgcttgtatgcagctgtatcaaagtcctcgacatctgtagataccacactgccgttttttgcaacaaacaccgtgctgtccttggtataataatctgtaccgcacccggcaagcaaaccgcatgtcgcaataacaggcaacagcattgatagctttttattcatagctgcctcctaaaatataatctatgatattatacccttttgtatatatgatttcaagtatcatattttaaagggcaacgacatgcatagtatctattaattatttcatgatttaatttcatgctttaatttatcacagaaaagctgctgatttaaaatcatgatgcacatagattgaaagatattccttcattatgcttctcagctcctcaagcacatcgtctgacactgcaaacgtgtacagcttcgtgatatcagctgaaacaatatactgcatggtatagagtgtatcgcttagtatacgcctgccctgcacctgcgtgccacagttgtcgcaaaacacccctccgcgtcttgccgaaaagacattaagtccttcccttgaatgacagtgtatacacgaaaacagcgatggaccctcgccatttatcgtaatagccttaagctcaaaaacagccctgaccagctcatttttatatgccggtgattcaagagcacggagtgattgataaaggagctttaacatatccttctcgtcattgttctcctgacaaaaatatccgcagaactccagaaagtaaaacccggtgtatactgcttccaaatcctgtgtaagctccctgaaatagttgctgattgtgacctttgaaagagaatatgcgcttttaccctcaaacagctcaaactcaccgaacgaaaatggattgcttcctgccataagctggctgtttggacgtcttgccccccttgcaaaggctgtgattttccctcgttcctttgtgagaatcgttattcttttgtcaaaatcccctaccggcatggctgaaagcaccataccggtcaacactacactctgtgacatcttaatcttactttcaaaatactattcttcctctttgtatccaaagttcttgataaggaagtcgctgtctctccaatccttctttaccttgacccatagcttcagattcaccttacagtcaagcagtctttccatctcatagcgcgcattggtaccgatttttttgagcatactgccctgctttcctataatgattcccttatgggagtctcgctcgcagacaattgtggcatccatatctataatagaaccactctttgtctttcttgtcttcatgcggtcaattcctactgcaatgccatgcggcacctcgtcatttagagcatggagcgctttttccctgataatctcagcacagattgcacgctccggctgatctgtgatggtgtcctcatcatagaactgtgggccataaggcaaatacttaaatatagaattaataacatcatccgtattctgtcctcttaaggctgacgtaggaataatctctgcaaagtcgtataccttgcggtaggtgtctatatactcaagcaccttttccttttccactgtatctaccttgttgataatcaatataacaggtgtattaacctttttaagctgctctatgatatgctgctctcccgccccgataaagttggtcggttccacaagccacagcacaacatccacctcatttaatgtcttttccgccacattgaccatatactcgcccagcttgtttttggccttgtgtatgcccggagtatcaaggaacactatctgtcccttttccatatccgtgtatactgtctggatgcggtttcttgtggtctgaggcttgtttgaggtgatggcaattttctgaccgataagcctgttcatcagtgttgacttgcccacgtttggtctaccgattattgtaacaaaacccgatttgaaattctgtatcatttttcctcctatgtgaatctgtatttatataagcttttcaacattctcaaagagccctgccgactctttaatcatattttcattgccgatgacacatatactgtccttcttaagtactgcctctacaaggtctgcaagccttctgatatcctccggctgtgcatttagtatctcatttctctccttttgaatctgctcgtaggtaataccctcgagatatgccgacagtgatctgctgccctttgcttccggattcataggcgtatcaagagcactgaaggtaccgataatatacttggtcatatccctctcatcaggcgaaaagctctttatatactcaggtatcctgtcatagacatcaagtgtgtctgaaaggttaggatctctatatgagacaaagtagctctctccgcttctaaggaatgtattcatgcagccgtaagcaccaccctttaccctgacatttatccagagataatcatagcttaagatgatacgcagcagtctcagtgctccggtgtattcatagccctcacagatgaaatcacctgtctttgccacatactgtatctgtgatgcatcaataaatgcttcctttgctgtattaaaatgaacctcagcctgattgcctacagcactcattttattaaatccagctataactttttctaacgaaggttttgcattgccgtatgcctcgttatttccggtaaagctgataagcattctgtttcttgcaaacagctttttggctattgcagcaagcttatctgacacactctttggtgactcggaaagtttcttttctatgcggcatatagaacggtaaaaagcaattccctttagctcgtcctgataaagtgcgtagcgcgagaagctcgacatgcttcgcatagctgcaaccaaatgaccggaactgctaaggttagcctgaagccttgccttaatctgcgctacaagctcaccaagtctctttgtatctgtaaaatccgatgaaagaagcatctgctccataagctcaagtgccttgtcaagatttttctccaataccttaagcttcacctcaaacttaaacacgaaattatttctatccttaatatccgggtgacttgcagtacctgtgctgattccgccggtatatatgttggtagcattggataaatcggtatagctgtacttttcggtgctcaccagcccgagtgcgtttgtgaagaagccaagatagccaagctcactctgggcaaaatcacctgcatcaaataaaaatgatatataatcaatgccgtttgactctatgtcatgacgcacaacctttacatccaaaagttcatcctcaatatttgaaaaaggcatagcattctttttcatatctgctcttgtaagcatcggaagcttgcgcagatcctcgtctgacgaaggctcctcctggtatttctttaaatgctctgtatcctcaatcagctttttaatctcttcatctgaaagagatgccttgtaatcggaaagttcctttgccaaagcctcctccctctcattgccaaggccacgcttcggctttactgtgacagatgaaccatgggtattgtcaagcagatactcctgtataagcttttcaaaataatcagtatctacagcctttcgaagcttagcaaaggtaccaagacactccagatgtataaaaggcttcatatcatcaaacagccagctgtctaaacagtttaatccaaaaaggagtcccttaggaaactgtccaaagtcagcctccctgaatttgaactcgctgctgttgattcccgcaaggagtgcttctttattaattcctgttttaacaacttctttaagagtgttttctataatactttcaaactcatccgcctgagatgcattggcattctttgccacaaacgaaaataccggctgcagaatgcccgcatcatatgagccatacacatcatcaccgattcccgcatctatcaatgcctgcttcaccggtgctcccggtgagctgacaagtgcatagtcaagcacatcaaatgcctgatagagcatctcatcaagcgaatcccctaccacacggttataagatagataagtcttattctcctgtgaatcatccatggtaattgaatactgtgcctcaacattctttatttcatcaaatgcaggctgtttattaatttctgaattaacttttttataatcatacaggctcagatattccttatccagccactcaagtctctcgacaacatccatatcaccatacagataaatgtatgaattggatggatgataatacttatgatagaagtccagatatgcttcatacgtaagcttaggaatatactccggattgccgccagaatccttgctgtaggtattgtcagggaaaagcgagcggtaaatctggcttgaaagcacctcatccggcgatgagtatgctcccttcatctcattgtacaccactccgtttatcttaagctcgtcatccttgcctgtaagctcatagtgccagccctcctgcttgaaaatctcctcgtactttgtgatattcggattaaacactgcatccagatacacatccatgagattcttaaaatcctgatcattgcagctggcaacaggataaactgtcttgtcagggtatgtcatggcatttaaaaatgtattgagcgagccctttgccagctcaatgaagggatcctttacagggaacttctttgaaccgcagagtgtggtatgctcaataatatgcggtacacccgtctcatcctccggcggagtcctgaagcctatataaaagaccttgttatcatcattatttgataaaacggcaatccttgcaccactttttttgtgtctcagaatgaatccatccgactggacatcctccactctgtgctcatctaaaatctcgtattcagccaaatcgtgaattgtcatcaattattcctcctaaaatgcgatgatgatagtataccacatttttacatattatagttaaattataagtatatttaccacaaaaaatctgttaaagtagtattctgcaacacccggctttaaaagtcagagtctatgctcctcttctgaatattaacatccatctgtggaaacggaatttcgatgttatttttatcaaatgctgttttaatttcttctgtaagctgccattttgtgttccagtaatcctcgttcttcacccatattctcgcaccgagctctattgccgaatcctgcagttcactcacaaacacattgctcggctcatcgtgaagcatcgcatctgctgatgtgacaacagattccagcacactctttgcaaatgctaaatctgtgctgtaggatactgttactctcaaatcaagcatcctcttatccatcatagatacatttgtgatacacgaatcagcaagctttccgtttggtatcataaccatcttgttatctattgtcaaaagccttgtataaaacagatttatatcctttacagtgccctctgtaccacttgaaccgtcaactatgtaatcgcccacgctaaacggcttcatcaaaagaataagcacgcctcctgcgaaattcgacagactgccctgcaatgccatacctacagtaagtccggcagagccaagaaccgctataacagagcctgtcgccactccaaagcccgaaagcagtgccatgacaagaataaaatacaaaaagtatttaataacatttgctagaaatgatgccactgcagcgtccattctgcttttatcaaatccttttttaattatttttacgactgatttaatcaccttaatacctataagcagtatcacaatcgcaacaacaagctgcacaagaaaactgataagcgatggcatatatttctccagatacgtctttacaatgcccgggttttcaataacctgctgtacctcagtgtttgcaaccggcactgatacttcaccaagaatttgtctgatcatataatctcctatatatctcttatatatttgttatttccttataacccactaaatcccccatataaaatatgggggatcagtatttaaatcaaatattaattcactatttaataactctcactctgagcactccgtcaatggcagaaagcttctcaacggtagaagcatcaatagctgaatcaagatcaagaagtgaatatgcatagtcacccttgcccttgtttgtcagatcagatacattaatatcagcctctgcaagagctgttgtaatctgtccaatcatacccttaacattcttgtgaaggattccgactctgcctgaagctgtgcatgcacccatgctgcagtcagggaagtttactgaatgaacgatattaccattctctaagtaatctctcagctccttgacagccataactgcacaattgtcctctgactctgctgtagatgctccaagatgaggtgttacgatgcagccctttgctccaacagttgtgttgttagggaaatctgaaacgtacttcttaacctttcccttggcaagtgcatctaccatagcctcttcgtcaacgagaagatctctggcaaaatttaatacgatagcggttggcttcatcattgcaatagcatcagcgtttaccatcttctttgttgaatcaagaagaggtacatggattgtgatgaaatcacagttcttgtagatgtcctcaacattgctgatatgcttaacgcttcttgaaaggttccatgcagcatttactgagatgtatggatcatatccgtaaacatccatgcccatatgtactgcagcatttgcaacaagtacaccgatggctccaagtccgataacaccgagcttcttgcctgaaatctctgttcctgcaaagttctttttctgcttctcggctgtcttcgcaatattctcatcgttctggtttgcaagacaccagtcgatacctccaacgatatctcttgatgcataaagcattccggcaaacacaagctccttaacaccgtttgcattggctcccggtgtgttgaatacaacgattccctgctcggcacacttgtcaagcggaatattgtttactcctgctccagctcttgccacagcaagcaccttgtcaccaagctccatgtcatgcatagcggcacttcttacaagtgctgcatctgcatccttaatatcatcaacctttttataatcgtcagagaacaggtcaagtcctactcctgcgattgggtttaagcatgtgtaattaaacattatgcattctcctcctcaaacttcttcataaactctacaagcttctcaacgccctcttttggcatagcattgtagatagatgctctcattccgccaactgtacggtgtcccttaaggtttacaaatccggctgcagttgcctcctttacaaacttggcatcaagctctgcatctcctgttacaaacggaacattcatgagtgatctgtcctcttttcttactgttcccttaaagagcttgctctgatcaaggaaatcgtagagaatcttggccttctcctcatttctctccttcataactgaaagaccgcccatcttcttgagccatttgaataccttgccacagatatagatgccgtagcatggtggtgtattgtaaagagaatcattatcggcctgagtcttccacttgagcatggttggtgtgcccggtagacaatcatctgtgataaggtcctctctgataattgctataactactccggcaggtcctacattcttctgtactccgccatagataacagcatattttgatacatctacaggctctgataagaagcatgaagatacatcagctacaaggttctttccctttgtgtttggaagcttcttgtactttgttccgtagatagtattgttctcgcaaatatatacataatccatatcatctgtgattggtaaatccgagcagtcaggtatgtatgagaaggtctcatctgcagacgaagcaagctctacggcgtctccgtaaatcttagcctcggcaaacgcctttttagcccactgacctgtgataatgtatcctgcttttttatttttcataaggttcatcggtacctcagcgaagaactgtgaagcaccaccctgaaggaaaagtaccttgtaattgtcaggtatattcataagctcgcggagatccttctcggcatccttgataatgtcatcaaaccatttagatctgtggctcatctccataaccgacattccgcttcccttataatccatcatctctgctgctgcttcctgcaatacctcctcaggtaaaactgcaggtcctgctgaaaaattgtaaactctactcactctaatttcctccttgtgtcgcattgtagtcctcttcatcgaaagactcgttgataggcttgcccggtgcaaccataggccataccttgtcatctgaatcaatgatacaatcgatgacaaacggtgtcttgctctttaaggcatctgcaaatgctttttcaaattcttcctgggtcttaacacgtcgtgcggtggctcccattgcttctgaaagctttacataatccaccccatcatcgagtacggttgccgagtaatgcttctcataaaaaagagtctgccactggcgtaccattccaagtacatggttgtttattataacctcgataagaggaagcttttctcttgaagctgttgcaagctcgttcatgttcattctgaagcatccgtcacctgcaatattgactacagtcctgtcaggattagctgtctgggcaccgattgcagcacctagaccgtatcccatggtaccaagacctcctgatgtaagaagagttctcggcttgctgtatttgtaatactgggctgcccacatctgatgctggccgacctcagtaaccattatagcatttccttttgtcatttcatagattttttcaataacaaatggtccgctaagtccctctttgtgatatgtaagaggaaaagtctttgcatatgcaagcacatgctcaacccatgaattgtggtcaagctgtgtgagctttttgtttatgcgtgtaagtatttccttcacatcgcctataacactcgatgtaacacggatatttttattaatctctgctgcgtctacatcaaactgtaatatctttgcctggtctgcaaactttttaggattgccaagcactctgtccgaaaaacgtgtaccaatcgcaatcaaaaggtcgcactctgaaactccaaggtttgaggtctttgtgccatgcatgccaagcatgcctgtgtagttatcacttgtgccatcatatgcacccttgcccatgagcgtatcgcaaacaggtgcattcaccttgtctacaaattccttaagctctttgcttgctccggagagaaccactccgcctcctacaaatatatatggctttttggatgcttttatgagttcaattgcattatcaatgtcactgtctgtaattgtttctgtcacacgctcaggaagcttgatttcctgtttggtgtactctaccagatctgccgtaacattctttggaatatccacaagcacaggacccggtctgccttttcttgctatatcgaaggctctgcgtattgtatctgcaagcttctctacatcctttacaataaagctgtatttggttacaggcgttgtaattccggcaatatctatctcctgaaagctatcctttccaagtaacgagactccgacattacatgtgattgcgacgattggaatcgaatccatgtatgctgtcgaaattcctgtgaccagatttgtcgcccccggtccgcttgtagccagacagacgccaacttttccggtgcttctcgcatagccgtcggccgcatggcttgctccctgctcatgtgaggtcagcacatgcttaatctccggatgcttgtagagctcgtcatagacattaaggatggctcctcccggataaccgaatactgtgtcaacaccctgttcttttaagcattctataataacctgtgatcctgttaactgcatcttgtattcctctttttcttatacgaatcctttacgataataggtgaaagccttattcgtactgaattttctatcaaaatttatactacgcgttctgctcgcccggaagtgcaaggatggctcctctgtttcctgatgtaacaagtgctgcgtatctcttcaaatagcctgttgtaaccttcggctcccttggctgccactttgccttacgctcagcaagcacctcgtctgacacatcgagctcaagcttcatgtttggaatatcaatctttatgatatctccctcttcaaccagggcaatcggtccgcctactgcggcctcaggtgaaacatgacctattgaagctcctcttgaagctcctgaaaaacgtccgtctgtgatgagtgctacagagcttccaagtcccattccggcaatagcggatgtagggttaagcatctctctcattccagggccgccctttggtccctcgtatctgatgacaaccacatcaccctctacgatcttgccgccctttattgctgcaattgcatcctcctcgcagtcaaatactcttgcaggtccctcatgaaccatcatctcatcgacaactgctgaacgctttactacagagccgtccggagccagatttcctttaagcactgcaagtcctccggtctttgaatatggattgtctaccggtctgatgacctcagggtctctattgactgcattctttatattctctccaactgtctttcctgtaacagtcatacaatctgtatttaaaagtccgatatcagcaagctctttcatgacagcccacacaccgccggcctcgtttaagtcctccatatatgtagggcctgccggggcaaggtggcagagatttggtgtcctctcactgattggatttgcaaagctgatatcaaaatcaaagcctatctcatgagcgatagccggaagatgaagcatagagtttgtagagcagccgagtgccatatcaactgtgagtgcgttcattattgcatcctttgtgatgatatctcttgccttgatacccttgttgtacatatccataacagccattcctgcatgctttgcaagacggatacgctctgaatatacagcaggtattgttccgtttccgcgaagtcccataccgagtgcctctgtaagacagttcatagagttggctgtgtacattcccgagcatgaaccgcaggtaggacataccttgttctcatactcacatacatcatcctcagtcatagtaccagcagcgtatgagccgacagcctcaaacatcgatgaaagacttctctttctgccctttacgtggcctgcgagcattggtccgcctgatacaaatactgtaggcagattaagacgtgcagccgccatcagaagtcccggcacgttcttgtcacagtttgggaccattacaagtgcatcaaactgatgagcgattgccatacactctgtagaatctgcaatcagatctcttgtgacaagggaatatttcatacccacatgtcccattgcaataccatcgcagactgcgattgcaggaaatactacaggcactcctcctgcctctgcaactccaagctttacagcctcaacgattttgtctatattcatatggcccggaacaatctcattgaatgagcttacgattccgaccataggctttttcatttcctccggtgtaaaaccaagagcattaaataaacttcttgccggtgcctgctgcattccggctcttgcgttatcacttatcatattttatctccttatttatctccgactatttctttgagtacttcatcattactactgtatacacaacaatctgcatatctataacctattagctgtctattataagtcatgcagctacacacgttctgcgatgagatcccccatctgtgctgtgcctacctgtgtgataccctctgtagtctcacccggctgtggcatgatgtcgattgtcctgtagccctccttaagcacctgctttacagcatcctcgattgcctgtgcttccttgtccagatcaaatgaatagcgaagcatcatggctgctgaaaggattgttgcgatagggtttgcaatgccctttcctgcgatatcaggagcagatccgccacttggctcgtaaagtccgaactttgtatcgttaaggcttgctgatgaaagcataccgattgagcctgtcaccatacttgcttcatctgataaaatatcgccaaacatattctctgtgaggataacatcaaactgcttaggatcctttacaagctgcattgcacagttatcaacaagcatatgctcgtatgtaacctccggataatccttagcgacctcctcgacgatctttctccataatctggaagaatcaagcacatttgccttgtctacggatgtgacctttttccttctcttcatggctatatcgaagcctcgctttgcgattcttctgatttcattctcattgtatgtcagtgtatctgtggccgtaacaactccatccacctcttttgtctctctggctccgaagtaaagacctcctgtaagctcacgcataatcatcatatcaaagccgtctccgatgatatcgctacggagcggacatgctgcagcaagctccttgtacaggtatgccggtctaagatttgcaaacagattgagtgactttctaagctttaaaagccctgcctccggacgaagctcaggggccagcttgtaccatggtgatgtggctgtgttgccaccgattgaacccatcagcaccgcatctgaatcaagcgcagtcgcaatagcctcatctgtaagaggaacacctgtagcatcaattgagcagccacccataaggatgtctgtgtagttgaagctgtgtctatacttgtctgctattttgtccaataccttttttgcctcagtgactatctccggtccgattccgtctccggaaattacaccaactttatattccataatttcttacctcttttacataaaaatacatattcttatattaaagcattaaagtagttatttcaatatgccgggatattttactttttcatgcaatttataactgcagcttataataactgcatactataataacagttttttattattattgcaagagatgcagataataagaaaaccgccacttatgtgacggctttacaaatctgcattatttagctgaatcctctgctttctcaaggtcagcgatagctgccttctgcattggaatacggcagttcttgttgttaccaaactcaacgattacagtatcgtcctcgatatcgataactgtaccgtaaaatccacttgttgtaagaactgtgtctcctgttgcaacttcattaagcataagctcctttttcttctgctccttcttctgtggacggatcataagaaaatacataactgcgaaaagtactactaaccagacaaccattccaattgttcctgctgcctgaccgtttgctaaaattgatgtcatcaattgttcctcctaaatattctataattgatgtgttctaagcactattaccataatacacgttaaacgtgctaacggcaaggattttttatcattttcgagattttttatatttatctgctagctctgctctccctgtgtcattccatagagcttttcagccttgtatgaggcaaaacggcctgcatcaagcgaatcccttatctcctccatcatgttgttgtagaaatacaaattatggagcacgcacagtctcattccgagcatctcctttgcctttaaaagatgcctgatatatgcacgcgaatatgtgcggcaggcaggacagttacagccctcctcaatagggcgcatatccttctgatacttctggttgaacagattaagcttgccgtgattcgtgtatacatgtccgtgacggccgtttctgcttgggtacacacagtcaaagaagtcgattcctctctctacaccctcaagtatattggcaggagttcctactcccatcaggtatgtaggtttattaacaggcagatgaggcactgtttcatcaagaatatggtacatctcctcatggctctctcctaccgccagtccgccgacagcatagccgtccagctcaagctcagaaatgcgctttgcatggtcaattcttatatcatcataaatagctccctgattgatgccaaataaaagctgctccttgttgatagtatccggtaagctgtttaagcgtgccatctcatttttgcacctctcaagccagcgcgcggtcctgtttacagagtttgtcacatactgtctgtctgcaacgctagatgggcactcgtcaaatgccatagcaatcgtggagccgaggtttgactgtatctgcatgctctcctccggtcccataaaaatcttggcaccgtcaatatgtgagttgaagtacacgccctcctcctttattttgcgaagacctgccagtgaaaacacctggaatccgccggaatctgtaaggattggtctgtcccacaccatgaatttgtgcagtccgccaagctctttaatgattttgtctccggttcttacatgcaggtgatatgtatttgacagctcaacctgacactttatctcctttaaatcgtccgtagagacagcgccctttatcgcacctactgttcctacattcataaatacaggtgtctgtatatctccatgcacagtatggaatgtacctctcttggcacgtccctcttgttttagtaactcatatttagccatattttcgtttaattctcctgtttcttttacttatcgccattgcctacgatttttctgattaatattccgttggtcagcagtgtggtatctatgcaatgtctctcaaaaagtacctcgccatcctttggcacctcaatatcctcatcagagcagttgactataacctccacatatgtatccacccagcccatctttctgaactggattaccctcggattgtcagcaaaatcgtcaggaaaatggaagtttctgccctttaaaagcggctcactcgcccttaaatgaatgagctttgataccatctcaatgcgctccttaaacttgcctgcctcaatatcatcccacggcatacatcgtctgcagtcagggtcatagctgcccggcatggcaatctcagtgccgtaatatatacatgggctgcccggcatggcaaaaagcactgcaagctgtgcaaagtactgatcgagattctttgtatcagagcgaaggcgctttgtatcatgtgaatcaagcagattgaaaagcacatcattggtctgctgcatgtagttggtataacatctgtttatggtatactcaaaatcctgattcgtctggctcttatctatccagaaatccttgatgctctctccaagcggatagttcataaccgcatcgaactcatctccacgcagccacggaagagcattatgccatatttctcccaaaatgtaaatatccggattgatttccttaagccttgccctaagctccttgcagaagcggtgtgacacctcatttgccacatcaaggcgcagtccgtctatatgataattttctacccagttggcgcagatatcgataaaatattttcgcaccgccggattatttgtattgagctttggcatattgtcaaaaaatccaaacgtataaaactgtccctttttagccgctccatgcttaaagtcaagaggccattcattgatcataaaccagtcataatactctgaatccgctccatttgctaaaacatcctgccacggtgcaaaataatagccacagtggttgaacactccgtcaagcattattctcatatcacgcttatgggcttctagcacaagcctcttaaaggtctcttcatctccaaagcgcgggtcaatctttgcataatccgttgtatcatacttatgattgctcggtgactcgtttatcggtgtcaggtagattccgtttattccaagctcctttaagtaatcaagcttttgaatgattcctgcgaggtctccgccgaagcactcctcatttttgacctttcccctgtttctccatggaacaacataatcaggatctatcgagtggtctccattgcagaatctatccggaaatatctgataccatatagtgtcatttacccacttcggtgtgaccggaatatcacacggattcatccacgggaatacaaagcactggcggcttctgccctcaagtgccatctgctctgcactcacgaagccatcctcaaagtaaaaccatctctcatcctctgtgatgagctcaaaataatatttaagtctcttgaatggtggctttaccgtggtggtccaccatatctggtgctttaatttctttttaaatattatcggctgcttatcgccattccaggtctcaccaccgcctaagataccggctgcgaatgggtcaccgagtatgatatttacttccttcacatcataaccggtctttatatttatgattaattcatcctcatttaaaggatagcagtagttgtcgtatgcctggtgaaataccccgttaaattccatgttttctccctcttttgcggtcttattgtagtcattgttttgttgcttcattgtggttctaaggacggcacgtaagtcgcggccaccgtgatcgtccacgcgctgccctgttcgctacgctgcgctgttaagattctgtacgaattatgcttatagattttctccggctgacgaaaccgtcgctactcgccctccatggctcgatagctccttgccccggcgtccctgccggtgcatttctgtgtatcgaagcataattctacagactctaaacagcttcgctattctctcccagggcagcacgtgtacgctcgcggtggccgcggcttacgtgccttacgttgtggcaaaattgctacaaatgatgctgcttaattatgcttcgcttaatttgcgctttgcatatacaggcatgtaaatatagttacatatatacataattatatacaaacatagttcgaaagttatctaaataaaataatatcatagttttcttgactattcaacttggtattacttataatatacctattattataataaggagaccatcatggcaggttcatcatacggaaatatttttagggtaacaacatggggagaatcacacggaaatggcttaggtgtcgttgtggacggcgttcctgcggggcttgagctgtgtgaggaggatattcagatattcttaaacagaagaaagccgggacagtctaagttcactactccacgcaaggaggatgatgcggttgagattctctccggtgtgtttgagggaaagactacaggtacacctgtttctatggttgtgtggaataaaaatcagaaatcaaaggattacagtgagattgcttcgtactatcgtccggggcatgctgacttttgctttgatgagaaatacggcttcagagactacagaggcggaggtcgttcttcgggacgcgagacaataggccgtgttgcagcgggtgctatcgctgtaaagatgctctcgggccttggcataaaatttcttacatacaccagatcaataggtcctgttacaattaatgaggttaattttgatgcccatgagatttacaacaattcactttatatgcctgatgccgatgcagcgctaaaagcttctgaatatctggaggaatgccttaaatcactcaattcctcaggcggtgtgtgtgaatgtgtcatcacaggtcttcctgtcgggctcggtgatcctgtattcgagaaaattgatgccaatctggcaaaagctattatgtctatcggagctgtaaagggcttcgaaatcggcgatggctttgatgcagcaaaggcaaccggacttacaaacaatgatgcctttattatgatggatggtgctgtttcaaaagagacaaatcactccggtggtactctcggcggcatgacagacggctcaccgcttattttcagagctgccataaagcccactccttcaatcgcagctacacagcacactgtaaataaatccggtgaagatatagagatttccatcaagggacgtcatgacccgattatcgtgccacgtgctgttgttgttgttgaagctatggctgcaattactattgcggatgcactgcttatgaatatgggagcacgcatggaccgcatcacagatttttataaaaaattataactttgtcctatattaaaaagcatctatccggtttttacggacagatgctttttatctatttcattggaacaatctgtaatgtttttcctagtgaattcaaaatatattttagaatatatttccaagaagcagcggattaaacaacatatactgcgcattcgtcaccccaaaagccacaagcgccagtggtagcacaataaaaaggacgcatgatataatcacagacatgccgcttcttaagtatttaaacattgcaaaaacaaacaggctgaccagtaatccccctataaagcgcatcagcattatgataagtatatactgccctaccgatatatcctgcgaaacacgccacagatgctccatacttgccgccggagcattaagcccctgcgtgccatatgccgaaagcacattgcacagccgcacaatatatacaagtgcaaatgctgtgacagtgcccaaaaagccaagtatgcatttgattcccatatgctgtttcctgccacggcgggtagtccttaaaagacggatttcatggtttgcataatccgctccacatataccgcaggctattgctattaggagaataacatacacaaatgcctgtgctgtatcacggtttttgaagtctgttctgtcggtaaggatatcatagcccttttcaaaaaacagccagccctcttttaacgtcttaagataatccacatgtgctgtaaccttattgaaagcctcctgtctgctcagttcatccttgtactttatattgatatagctttcactcttcccctgctccatatcgtaagcaatgttatctgacagtctgtcgtattttactctttcttcatccagaagctcattggttttggcagttaaaggtccataatatttgtccatatattccttgtaatacacctcatcaaccgagtcatatgaaagcttctctgccggattccaccataccacaaaaagagctgctgcaatcaaaataagtaacacttttcccggaacaagtgccttatagcattcgtgcaaaaataaagatgtatggcagcctgtatttttaccgcaggcaaagccgggcagtaaaagcagcttcttttcatgcaccgaattgagataatttgtaaccgcaaaaatacatacagctatacacacaagccagaacaagccatacaataccccggtattaagcggatatccaaacagattgatattgacataatcagaaaaaagtctgcctgtcctgactccgtacatgatatttatgtacttaaggaaggctaggaagctggttcctgatatcgttgtgtagcagatagcctcaataaccacggtcactgcagaagcaacgaacacaaatataatattgtcaagcgctgcgcatatcagcataaaaaacaagccaagcaatataaagcttattattttcactggaaaatagcatgccagaaattgtcctatactaagcttaaacggactgccatagtacagataaacactttgaagcggacttttcagatttatcggattgtaaaagcacatgcttatgactgcattgatgccatacaacagcaaggtgataagcatgaccgccataatcatcacaaatgactttgacgccataagctgccttctgccccttgcagttgttctaagcaatgcaagctggttctcgcttttttcataaaaaacaaggttgagcgcaatgataaaaagcataatcactgccacataatccgtgagctcattgtctgtaatattcaaaagtcccgatgcatccataacctcaggcactgtgccttcaagcttactgtagactctgctcgttttagcagcatttttctctgcaaagcctccattgccggaaaacttattcataatcgaaatctcgtcagccttttcattgacagagtccagaaactcatcataagaaagacatgccaatgcttccttgtataccctgctgcacagactaatcctgccgtaagcttctgccgtcatctgcctctgttcaatttccggcaaaacatcctcacgactgtaattgcttatttcgccatacagcgcgctgtagtccttacctgtatacccatcatcatttacagtattcatggtatacagtccaagaacaggattcagaacaagcaaaaacaaaagaataagcactgttcttttagtcaatagtttacatatttcgttttttactatatccattttcagtccccattaagatacaaatacaagtcctcaagatttggccgcacagcctccttctgccatctgccatcatacgaatcggcaataatgcgggctatgacaccgtctgcatcccttgaaatattgctcaccttgtatccggtgtttacctcatctatctcattatccgataaaaagatattccatacctttccatccagctccttaagcagctttgacggagaaccactccttattattttgccgttgcttaacataacaatctctttggctataaactctacatccgtaaccacatgagtcgcaataataacaatcttgtcctttgcaacctctgatatcagattgcggattctgattctctcctttgggtcaagccctgccgttggctcatccagtataagtatgccgggattgcctatgagtgcctgtgctatcagtgctctctgcttcattccgcccgaaaaagctccaagcttctttccaaggacatcatcaagctttaccatgcgcacatagtgatctatatcttccccggcttcactcttttttaatcctttcagggatgccataaagtaaagaaaacgcctaagactaagctccggataaatattctgctgctgtggcatatatccgagaagcttcctgtattcacttccaagctcgtctatgccccttccgtcaagcagcacacggccttttgatggagtcagattgtcagaaatgagattcatcatagttgatttaccggctccattaggtcccaaaagcccatatatgccgggtgtaaatgaaaaagacacatcatccagcgcagttttatccttataaacttttgtaagcccctccaattcaagtgtcattgtttatattcctcccactggtttcttacactgtcaagatagctgtccattccatctgctgtaagcttttcctttgcaccttctatactctcctcaaccgacttaccatttaagccattcatgaaattcgaaagatcatttgagatattgttcaaattctccgtatcaggctcaaaaccgataaacggagatactccggcattgtcataaagggcaaaaaactcatcttttcgattttccatgtatctttcacctgttaccggatatacatttataaacagatccagacagagcttacttaaatagtcatcctctagatcagtaccatccgtattgcatgcaacaccgtctacgaccttgtaatccgtgccttcctgtccatacaggagaatatctgcgtactttccgtttccatataacagacctaaaaactctaccacagcatcgacatccttagtgtttttcgctataccaatggatgcgtttacccttgatgtcagataatgctctactgtttttaccgctatattatctttttggaaattctcgtctatctctccggaacacaaagctacaacaaaattgccggacttaacattttgtaatatttcctcattatttaatccgatattattaaggtatgttatctcaccggtctcatcgtccttcaggtatccgtcttttttcatcttatcgagccccttaagatattccgtaaacttttgcgattccagtggattttcgactgacatcgtatcataatcgaagcaaagtccgtttcttatctcacagccgatcatatctccaaatacatattcgtttatgagatattgaaatcccggagctttgctgttatcccactcagaagccttgagtatctgataaattccatctatgcttccatcccacgaatttatgacatcatctgagagataatccctgttaaatgcagcataaactccattatcatccgcaaatgcagatggtatggaataaatatgtccatcacattttgccatctcccaaaggttctttgggaaagcatcataaagtgtctttccctgatctttcgacaaaacatcatcgagatttaagacaagatccgaacttataagatcatatgccggattatttccattctcatcacctaaacctaaaaatgcaacatctgttttcccggcagcaagtgtactttcaagcttctggccgtattcatcatactccagatattttatattcagctcatagtcatagccatcattcataagtgcagcattaaactgcttaatgttattctcatcgatcctgcaaatatcaggtacagcaaatgttatgacctttgtatccgactttttgactgttgcctcggtctgtccctctttaagttttcctgaatcacctgcttttttattaatacataccgctgctactgccaccacgatcagggcaatcactacaactgctattaaaacaccctttttcttattcttcattatagcacctcaattttctcggattaaaattgcctttattcagatcatcaagacttaaaactccaagtgaaaattcgccttcatcatcagtatagttgacatataccgactgaccgcatatgttttcaataccaaatgccttttcagtagacagcttcatcagttcttcactcttatcatccttcaagcggtaatatgtcacttcatcactgttttcttcagaaagggcataatataaaaagtctccgctcttttttaatggtccatattgtgtttttccatccgcatctatcggaagctgtcttgtctgtctgctttcggtgtcaaacacaaaatatccatcctttgacgaataataaccatcgccatctaacagccaaagatcgttaatatgatctatttccgtcagacatgttgtcttttcatctgctatatcatatcgatatattccattaagcatattatcataagcaaaagactccgcatcagctgacgctccctcctctatcatcagctctgtaacatcatctccaaaccgcacagtcgaatagtacactacaccgtcttcataatatatgtccgtaatatttgcctgttcgcttgttatcttatcgctcatatacaccttgtaattatcgagatctataacaaaaataccggcttcaggcttatcatcatttataatctgtccttcatcattaagctctattctgttactgtaagctcctataacataattatccctgtacaaaacagccgtaatttgttgaacattctctaatttagctgtttttttccgattctcaccattagaatccatcacatacagatactgtattgtcatgtcttcctctgacatatcccctataaaatagagatgatcattgtaaattaccgctccagcttttgacgaactataaaaagctgcagggcatgaaggattctgatttgttcgcgagtatccttcatgtgtgcagtttggcttgtcacaatagacaatatccttaccggatgctgtatcaataagatgcaatattcccgagtcatcaaaatagaatacattatcctcagagtagttatattccggatttacattggaatatgtgtacattgtattggatgtactgcggtttctattctttattataaaaaccgcagtcacaatacagatgataagtatgaagatgattgatgcgattaatatgcgttttttcttcatagtgcccctccctttttgataatattatacataaaacaaattaccccgaatacaaaaggcgaaattagtacttttcaaggtgaatttattaaattttcatcaatattttcacggtgaaccgttcatctgaacactcaaaatccagtgtgcttatatatttatcaagcactttctttacattctttaatccataaccatgttctcttacagattgttttgtcgtaaccggcaatccccctttaaatatcactttttgtaaacacctgttactaatctcaacaacaagtgaatccattaaataattaatttccaaatctatgcttggattttttacatctttttgtgcctctatcgcattctccaaaaggtttccaaaaataatattcatatcatatgccgataagtttaaattacacggaaccacaactttaacattcacctgaattttcttatctaccgcacgctgaagcatataatttaaaactgtatcaagcgccgtatttcccgaatcaaccagtcgccttgattcgtaagtacgtaatcatccgtatctgtcagcaactatatttttctgatacactctgcctcaacaagtgcaagtacatcagcgagcaccagtgcctcaataagtgcaagtacatcggcaagtacaagtgcctcaacaagtgcaagcacatcggctagtactagtgcatcgacaagtgcaagtacatcagcaagtacgagcgcctcaaccagcgcaagcacctcagcaagcacaagtgcaagtacatcagctagtatcagtgcttcgaccagcgcaagtacctcagcaagcaccagtgcatcgacaagtgcaagtacatcggcaagcacaagtgcatcaacaagtgcaagtacatcggcaagtaccagcgcatcaacaagtgcaagtacatcagctagtacgagtgcatcaacgagtgcaagtacatcggcaagcaccagcgcatcgacaagtgcaagtacatcagcaagcacaagtgcatcaacaagtgcaagtacatcggcaagtactagcgcatcgacaagtgcaagcacatcagcaagcgagagtgcctcaaccagcgcaagtgagtcagagagcacatcagcaagtgagagtgaatcaaccagtgcaagtgagtcactcagcacaagcgagagcatcagcacaagcacaagtacgagtcagagtcagtcagctgcaaatgtggtaccgacaccggctcctgcaccagcaccggcagtagacaatgctcctgcacctgcaacaactatcacaccggttgctacacctcttgcagcagctacacctccggcagcaccagcaccagcagctcctgcggcaccggcagtaccgaatacaccaattcaggatgcacaggttccacttggagtaaatgaggatgaagataatcttcagaacatcgaggatgaggatacacctcttgcagcaggcggaacagccaaggacggtatcaaaacatggtggtggtggattgcagcagcagttgcagctatcacaggaaagggtgtttatgacaaccgcagaagaaaacctgcaaagagcgacgattcagaagataattctgatgagaaataaataattaatagcaatactaacaatattgttttataatattagtgaccatctgtagcggatggtcactaatttgttaagctgttttgtagtaagacgaaattactttgtgaggaaaggtgaattccttgaagcagaaggatagtataaagaagaaaaaacaaaaacaacagaaggaacacgtattattatataagcttttatattcgttcatgaccatgctcgtgtacatggtaggcagaaatataccactctacgggatagatatagatgcatatagcaatgtaaatgtagatgcgcagtccatacttttacaggctatttcaggtgatatgaagaactgttccattttcatcataggcttgtggccgtacatgctggcatccatgcttgccatactgatagttgcaatcatgtcgcttgacaatacaagaaagctgtcaccgaagaagataaacatatggacagttaccatcatgatgattatcgcagcagttcaggcatatcacaaaacacagacacttatgtatagagttagtggagatgaacttatatggaataagataatagttttcatacagcttatcgcgggcatgctgatagtggtgtatatgtgcgacagagctaccaagtatggtatcggtggcaaggtgagtgtgttcatggtcaatatagtcagtggtatgatgaccatgtttacgggaaagccgcttgagaagctggcactgcctgtagccataggagtggcagagattgctgtcatgatagtacttgagaccactgagaagcgaatagcagtacagagagtttccataaacaatatttatgcggataagaactatatcgcttacaagctcaatcctgtcggtgctacaccgcttatgtttgcgtcagccgcttttttgcttccacagtttatgtgcaatggacttcattatctgtttccggacaatgctgatattcagtggtggatggacaatatgaggctcacatcaccgcttggaattgtagtatacatggtgattatatgtctgcttacaattatcttttctatggttatgctgtctccgggcaggacagcagatgatctgcttaagtcgggtgattctatacaggatatatatgcaggaaagcctacgaagagatatctgattggcacagtgctcagcttttccgttataagctcaatcattatctgtatatgtcagggtggaccgctgtttttacagtttggaggatatgtggacgcatcacttgctatgctgccgtgctctatcatgatgacgacaggtctttggatttcgctgtaccgcgaggcagaggtgtaccggaatatggacagatatcatacattcatatagctcccggcgctttgaattaagaattaggaggaatcataatgctatattttataccggcatggtataaacagaatatgtggtgcgaaaacgagcagcagtggtatatgcgcaggctcaagtcagagtttgacgagactataaagcagattactctttttcatagaaatgtggacagaccttacaggattcttgtgctcggatactcgccaaatttcagacatttcctacacaggcagggcatgtaccgttcgaagtactggtcatgctttgatgcgatagcacaggtcaggagaaagaaggtcgctgtgctgtcatatcacgatatcaagtggccgaaggggctggagtttgtgtattcgcctttttctataattgctttgcagggcgatgtgaagtatgcacaggtagagtttggtgaggatggcaatccgatatccatagatatgtttgaggatggcaaaatctgcaggcgcaactattatgatgacagaggctttgtttccagtactgttatctacgaaaacggcatagagcagtatcaggattttttgatggaaaacggcatctggaagatacgtgagtataaaaatgatggtcatgtggttgtcaatcagacatgccctgactatgatgtggtgcctgatgccaagagcggcaaagcaggtgagccggttgagatgcgctttacaaaggctgaatatgacagcctcgaggcggttatcgaagaggtatttgcaagctatgtgaatctcacaaggcaaaatgacaactttttcgtggcgatgcatccgcttcatatcagggttgcagagcatgtgcttaaggggaaaaggattattgctacattttttgaaaacagatttgatttcacgcagacatcactggcagcggattttttagagcatgcggaaaatatcattacggattctgattatacgacgaagattattatggcaaatctgggtgcagtaaataacaagccgttcagattacatatcacagatattccaccatatgataccaggatggatttcggtatcagctcgcagcttcgggtgcagaacatcctcgtgccggttgatggactgactaaggatgcatttgctcagattataaaggggcttgcggattatctgaccattaatgaccttgcgagagttcatttctttacaagagatgcctcatggggtcatgaggatgctataaagaatgatacggtaaagcttcttgatagtatgggctatgattcccgtttggtaacaggcgatggtgaggcagctctcggctttggaggcagcggggctgatgtatttgccgagaatgagctgggggatatagaaaaaacggtggagcagagatttttcgtggatgtatgtgtggatgagcgtgatatcagcaagtgtatcaacgagcagagagtcatcctcgatatgagaggcacgatggatgtttttgtttatgttacagctatcagcaagggcgtgccgagaatcagcctgagtgcagaccagtttcttgtttcaggaaaaaacggaatggtcatagatgatttttctgatatcggaaggagtctgacctattatctggacagctttgaaaactggaatcaggcattggtggagtgctatgagcttggtcagaaatataccacatcggtgctgcttaagaagtggagaaaggtgctaaattttagtgagtaagattcatgttttatatgttggcgatgacgattggacaactaaatacagcattccggacaatatagagtttgaagtatacgagtctgatgagagtgaactaacggcaaacagacctgcgagaaagctcatggatttagttattcttgacagggatataacactctcagaggaaaaggcttttacgaagtttacaaggggctactgtctttttgcaacggaaaatgtgcagatgctaaacagcgcgacgagcagatatttcaaggcacgaatgggacagtatctgtataccggcgatgtgcagtattttctggctcatgaggtgagaaattactatccaaatccttatggtgagaagtttaatcctgccaagcttgctgtcagtgattcctttacaggaagggtagcatgtgatggaaactataacttggttctagatggagagtttggggaggatttttcgcagattgcatactggagatataatatcccggtttttgagggacagtgtattgatatgtatcttgaatatgagaaaactggggatgtagagattaagcttagattatttcagttctactatggctcgattggtgatattaagcaggtctgggagtttgacgaggaacagcttcaggatgttttcagaatagataatgaatcagatcagggtcctgtttttgtttctatccttgcaaggggcaccggcagcctgaatatcatatcattgcacgacagacattcccgccgtggacacggatttttcctgcccggaggtgagaggcttgtctcttctaagggagaggaagtttttgtgtactttgagaagggtgatatgaagccaccgcttgctgtctatttctcaggctacaggactcaggagggctttgagggctactatatgatgcgaggcttcggatgtccgtttattcttgtgacagacccaagaagtgagggtggagccttttatctgggagacagtgaatttgagcagatgattacggattatgtgactgataagctcgatgagcttggtcttacaaaggatgagctcgtgctctcaggagcttcgatgggaaccttcggttcactatactatggctcaaagctttcaccacatgcactgcttcttgcaaagccacttgccaacatgggaaatgtagcacgaaacgagcgaatccttagagccggaggcttcgctacctcgcttgatattctgatgaaaaattatgacaatctctctgatgaggcgatagagcagttaaacaacaggatgtgggacagattcgacagtgccgactggtcgcaaacaaagttcatcatctcatatctgtatgaggatgattacgacccagatggttatccgagcattttgtcgcatctgaagtcgagcggtgttgaggtgtatggcaagggctcacacggcagacatactgacaattcagcaaatgtcatggcatggttcaagagccagtacaataatctgctgcatgatgatttttcaagataagcaaataaacgttgcaggtcacacagtcaggtgtgaacagtaacaggaaaacaaatattaagtgaacaatagtaagacaggtaagtattatgtatggtgacacatggcaggtccgctggaaggaatttctatcggactcgtatgtatatggatcaaaaattgaatttaacgaggatggttcagtttcttataagaaccgcctcatgccgccgggcacggtgattcacacatggtattctatgacgaatttccagggaaataggatagagccgtcgcttccgctcatcgatggagagcgggcgtattccattgcggtgaatatagactatcacaacagtgagagtgaggcactgatgcttcgcatcatattttttgacaggtatgatgtacaggcgcagagtattattgtccgcgataaaaaggcgtttttcaagccgtccatcagaacctacagctacaggatagagctgataaatggtggaaatgctgattttacattcaaatcactggtgattaaagaggtttcagaggaagagtttgatgcagagcaggaaagaattgagagacttaaagaggactctaacaaaagtaagaaaaagcgaagaaaaaataaaaaatctaagtgatgaagagctttctgcactgacagagcagtttaagagcaggtatagcgatggggaatcgcttgaatcgcttatgccggaggcctttgctgctatctgcgaggcggattacagggtgcttggaaagagaccgtatgatgtgcaaatcttagcggcagcagctcttcacggtggatatctcgccgagatgaatacgggtgagggaaagactctatctgccacgatgccgctttatctgaatgcgctgacaggcaagagctgcatgctcgtgaccacaaacgagtatctggcatcgcgagatggggcagagatgggagaggtctacaattttatgggtctcacctgctcatatccggatgcggatgatacaaaaaagcaggatgatgatgagaaaagacagttctattcggctgatatcatatataccacaaatggcacacttggctttgatttcctttttgacaatctggtaaagaaaaaggaggacagattcctctgtgatttccactatgtcataatcgacgaggcggattcggtgcttttagactctgcaattatgccgctcgtcatatcgggagtgccgagagtgcagtcgaatctgtacgatgtatgtgattttttcgtcacgacacttgtggaggatatagactacatagaggaggataaggccgtctggctcactccaaagggtgtgaagtttgccgagagcttctttggaatatccaatttttacggtaaagaaaattttgagataaacaggcatgtcacgctttctcttcgggcgcacaagcttttgaagaataaaaaggattatgttgtcactgacaagaaggaggtagagctgtttgatggagcgacaggccgtctcatgcacggtgtcaagctgcgtggcggtcagcatcaggctatagaggcaaaggaaaaggtggagatatcgcaggaatacagaactgtggcatccgttaccttccagaatctgtttatgatgtttgacaagatggcaggcatgagtggtacactcatggatgcaaaggatgagctttttgagacctacggcaagcatgtggtgagaatacctacaaacaggcctcttaaaagagttgaccggaaggacagatactttaaaaacggccatgaccagttctggacagcagtggatgatgtgataaggcttcacgagacaggccagccggtgcttgtggtgcttagttccgttacggatacagatcttttttcaaggcttttaatagagaaaaatatcccgcacaatgtactaaacgcaagcaatgctttctgggaagcacagattatcgcaggcgcaggccaactgaatgcggtcacggttgctacaacgatggcaggaagaggaacagatataaagctcggagacggagtgaaggagcttggcggcttagccgtcataggtataggaaggatgaacaattcaagatccgagaggcaggcgaggggccgcgccggcagacagggtgatccgggcttcagccagtactatgtgagcctggaggatgacatagtgggagctgaggatgatgacaagctgcagcgctatattgatggcaaaaagcgtattggaaagcgcaaaataaagcgtattgtcaaccagtgtcagaagcttagtgtggagtctgaggagatgaaccgcaagaaatcactgcagtacgatcaggtcctccagcgccagcgagacctaatctacgcaaccagaaaaaaactgctcgacggcgccagcgtcgagcaggagaagatagtagagattgcgaaggagaatatctcagacttcgttaatcattttgactgcatacagagtaataagaagcatggcaggcgccgtggcagaaagaaatataatgataaaaataccaatacagagcaatatacatcaatactaaacagatatatccttgacaacatttcttacaagctggacgccggtctgactttgtctgacatggaaagtgccgccactgttagcgattacctgatgcttcgcgtgtatcaggggctttcaaggcaaagggagcgcataggcgatgaggaggcttacgagcagtttgtccgtgaggcaactctaaaggcggtggatgatggctgggttgagctgattgactaccttgagcagctcaagtatgcggtagcgggaagagcatccgcacagagaaatgttatgtttgaataccaaaatgaggctttcgagtcgtttttggatacagaaaaagcggtaaaatgtaatatcataaggaatattttgcttagtgatgtgaaaatcggcaaggatggcaggctgcaggtcatctacccttaaaggttattataatataaatagtttgacagatacgaggagaatcatatggtatataacttcaatctcggaataggctgggcttcaagcggcgtggagtacgcacagagctacagggctaatctgctccgcagggcgcacattccggcaaggtttgttttcacagatatgtttccaacagaaaatatagagcacatgacaagaaatatcggctttttggatgaggaagtgatatggctgtacacattttttacagatgtgaggacatctcctgttacattcactctaaaggagcttgaggcttcgatggcagaggaggattataccttttccagagatgggaagacgtgcaggtatcagtttaaggagagcggcaggttctacacctgctacatggtcgatgatacaagtgatctagtgcacagagtcgagattgtatcaaacggatgcctgatcaggaaagatttctacacctattgcaggacctttagcgagtactatgctccgcttgacggcaaggctcatctgtacggcaggacatttttcaatgaggatggctcggtgtgctacgaggaggtcatagaggatgacagcaccttttacaggatcggagcgcaggtgctttataccaaggctgacctggtcggctacatggtaaagaggcttaacctcacggctgatgatgtggtgatcatcgacaggacgacaggcataggtcaggcaatcctcgaaaactgtggaccggcgcgcgtaggaatagtggtgcatgcggaccatttcagcgagggaggcactgatgatgattacatactgtggaacaactattatgagtattcattttctcagactgagcacatagatttctacatcacagcgacggatgcgcagaatgagcttatgaggcagcagtttaagaagtactgtggaaaagagcctcatgtggtgactattccggtgggcagtcttgatgagcttaaatatccggatgagccaagaaagaggcactcactcatcactgcgtcgcgtcttgcgactgagaagcactgtgactggctggtggaggccgttgtaaaggcaaaagaaagcgtgcctgacatttcacttgatatatatggaaagggtggcgatgaggcgaagcttaaggggcttatcggcaggctgggctgtgccgattatgtgcatttgatgggacaacagaaattagatgatgtatacaagcactatgatgcgtatgtggcagcttcacagagtgagggcttcgggctcacactcatggaggccataggctcagggcttcctatagtgggctttgatgtgaggtatggcaaccagacctttatcgatgatgggcaaaacggctacaggattccaatcaccgatgagatggatcagaaggagaagataaagcttctttctgagcgtatagtgaggatgtttacagaggatgatatggatgcattttcagcacattcatatgagaaggccaaagaatatctgactaaggaggtggttcacagatggatagagctgttgaagtaacaaacacggcggatggtatcacactgctctttgatacattttcaggcgagagcaagaatctccttgagtcatttaagaatgccggtgctgcctttcatgcagcagtcattgaggatgacggtttcctgacagatgatgtgatgagcgtgtatggatttttcttaggcgattaccgggaggctgacagcttaccggggaagccgctgtatttcaatcagatacagattcctgattactggcgcatagagggagataattcatctgcgaaggtcatggaccgtaccagggagcgagcgaggatatttttcacggagcctacgcacaggcggcaggttaagattgttgactggctcgatgatgccggtcaggtcaggctttcagagcattataacaggtatggcgcgattttctgtcacacggtttttaataaaaaggggcagaaggcactcaggaagttttttgatgtgacgggcagggagatgatagtggaaaactttgtcaccggtgatatactcgtcagatggcaggataaggactggattttcagaagtaagacagactttatagcgtttttcatcaggtgtgcagggctggaggatacagcggtttatttcaactcgctgtcatatccgttttttgcatcacaggcgcttgcgccaaacggctttcgcgacgcactcttctggcacgagccggtgggagatgaaatacccggcaatatgcagattatactgcatgatcagggaacgagggcaaagcgcgtatttgtgtcgcgcagggagtcctacgacaggcttatagcacttggcgctccttccgataaggtgaagcagcttggatatatctacagcttcgtcagggaaaataagcacaggccgcacatactcgtatgtaccaattcagagaatgtggggcatctgacagagcttgcgtcactcatgccgcagatgcattttcatgtggcggccatcacagagatgtcgtcaaagcttatgtcggcagggcagtatgacaatgtgtcactctaccctaatgtgaagatgtccgtgctggatagtctttttgagaagtgtgatttctacctcgatatcaatcacgagggtgagatagtggatgcggttcacagagctttcttaaacaacatgcttatagtgggttatgaggagaccatgcacaacgcatattacaccgcagacacgaatacatttaaggagagcgagtacgctgatatggcggaggcactcaacctgacactggctatgccgcatctcattgatgaggcgcttgccatgcagaaaaaggctgctgtagcggctgatgcaacagactacatggaaatactccatttgtagtaatacagggtttatgaacagaaaggagcttaatatgagtaaaaacattaacaacaatcagacagtagacgagaaaaagggtaaaaggacagggcttacaatactgggctatgtgcttgtgatcgtggcacttcttatagtgcttccggttgtgcttccaccgatatttggctatcatacatatctttcgggcacagaccatacaggaaatatttcaaagaatggcagcgtggtatatttaaagactattgacgaggcctcttataaggatggcaatatagtagccatcgaatcagctgattcatcaggcagaagggtagattcatactatgtggattctaatgattcttctgcaaaagagattgcacttcgtgatggaaatggtgtatcatataaggtagttaaagggcaggttatcgcaaagactccgtttataggatacttaagccagctgtgcttttcagcagttggaattattgtcacggtagtgatttttgctgcaggtgtagcaatcatgatgtatgtaaacaaaatcagcaaggaaatcaacaccatggttgaacagcagactgcatagtgtgtctgaattcccatctgcgacattagaaaacctgactattataaagcagaccttatgtttgcggaataggataagttatggatagatacagtgtgagtaggacaaagaggtcattgttttatttaatgatggcctttttgattgttggatttataattgccgagtgcatattaccgagtgagagaagccagtctgtaagtgataataatatcacctacgagggtagctttacatgggagaagtccgatggtgaaagggaggctattgaagtacccggcaggtacgatgttaagccgggggatacgatggttataactactgttctgcctgatgatttcaatgcaaatgtcatggcaatcagagcatcacttcagacagtcagattttacgtggatggcagtccgagagcagagtatgatacaaaggacacgagacccttcggtaaggattccgcgagcagatatgtattttgcaatatgtcggaggatgatgccggcaaagagctgcgcattgagctgacgagccatgcatccaactattcaggcgttgtaaatacagtatactgtggagataagagcgatatatggacaaatatatttcataacagctcaagagagacgattatagcatttttcattttttttgctgctgtagtgtctgttatgttcagtatagcactcagtattgtatacaagacacattttgacatggagtatgtaggctggtgtatgcttcttggggcaatatggatgcttggtgaatcaaagctgcgtcagatgctggtgccgaatgcatctgttttggcggctatgtgctttgtggttattctgattagtcctattgctgtttcgatttatattgacagcatacagggcgggcgttatacaagagtgtatacatgcatagaggcacttgcggctgtgaatttcattgtctgcacatcactgcagctttttggtgtgtgcgattatatagagactctgccggcaggacagggaatgcttgctgtctgctgcgtggtcgtcatcacaacatttatcattgatataattaaacacagggctttgggctacagacctgagatggttgccatgattgtggcacttgttctggcgcttatagaggctgcatctgtgtactttgttgtcactatgtcaggtttctttatcggaacaggccttattgtgattttgtttgtcaatatcatagtcacaataaaaagaatcagcgagatagaatacaagcgccagaaggaagagagtgacaggcttagaaatcagacagagagagtttcccttcagatgatgaagacacttgctgccacaattgaggcaaaggacgattatatgagaggtcactcatacagagtcgcagagtactctgctctcatagcaaagcagcttggctggagtgagcatgatgtggaaaatcttagaaatgctgcatatctgcatgatatcggaaagattggcgtgcctgatactatattaaataagccgaccaggctgactgatgaagagtttgccgccataaagagccatactgtgatgggcgcagatatcttaaaggatattaccctgttagaccatctggtggatattgcaaggaatcatcatgagcgctacgatggaaagggctatcctgacggactggtgggagaggagataccgctttctgcccgtatagtgtgtgtggcggacagctatgatgccatgaggtcgcgcaggatttacaggaatgctctgcccgatgaagaaatccgaagggaacttttggataactgcagtactcagtttgatccgcagatttcgcgtatgtttgttgatatgcttgacaaaggcatggttgtgattgatgaggataatccggcggctcagggctaccgtgataatgcggctatcgagtcagtggcagacaaattcatatctgaggtcatgaagaccatgagcagtcaggaaaaagccgatagtgttgattatctgacaggactttacatgcgaagtcgtggacagcaggtaatagcagccctgatgcaggataatgatggctgtcttgccttcatagatatggataatcttaaaaaagtcaatgatgtgcatggtcacaaggcgggtgacagggcacttaagcttataggtaatctccttgctaaagagactgagaatgagacctttgcagcctgcaggattggaggtgatgagttcctcatctttatgccatattctgacagggcaagcgtggagagtgttataaagcgcatatttgagggcttcgagagcgccagggaagcagactgtgagataaaggaggcagctctttcagcaggactgtgcatgacgacaaaaggagccatgtttgaaagtgactacacaaaggcagataaggcactttactatgtgaagcagaactgtaagggttcatatttcttctatgagcagctcttagctgacaataaggagaatacaaatctgagtgcggatttacgaaacgtggcaaagcttttaaaggagagtggcagctatacaggtgcgctggatttaaactacagagagtttgcaagaatctatgagttcgtgaacaatgtaggagataggcacaaccacaactgctatctggtcatggtgactatgaacactctgccggagcagcttgcagatatcgaggaaattgagaaggcacttgactgcatggagcagtctatccgcagcaagatcagaaaggtggatgtctgcacgcgctacagctcaatgcagtatcttatcatactatttgagccacaggaaaatcagattccaaatgtcatggagagaatctttatgcattactatgagctctgtgacagagagaatttcaagccgcagtatgagtatatcaaaatgactgaggtaaaatagggattgttaaataatagtcaatgtggtatagttttcttcgaacggtattcgaaggaaactgtatcatggaggatgtgttgtcaccttatgacagagcatatccggcagacacaaggaagccaaaagcacattgctgtagcagatatgaagcagacagcaaagtgacaggcgcgcacagggtaaatcgaccgctgccatacggcacatggcggagattatatcagctgcgagataaggaatggtctgaccggcttggaaagaaggtggtagcatgaaaataggcataatcggcgcaggcagagtgggctgttctataggtaaatacctaaggacaaaggacatagagcttgcaggctattatgacgtggattctgcggcggctaaggaggctgcggagtttacaaggacagagagctttgattcgctaaagcaactggcggatcaatcacagattatatttatcaccacaccggattcatttattataccggtttgggaacaattaaaagagctgtctctaacgaatcagattatatgtcattgcagtggcgcattatcatccgattcattttccggaagggagagcatgagcgtatcatgctgttcaattcatccaatgttaccgttcagtaacaaattttcatcatatgagcaattaaataaagcatttttcacagtggaagggcaggatgctgcggttgaagcaatatccgggctgttttgttctattggaaatgaggtatgccgcattgatggcgctaaaaaggcaaaataccatgcagcggctagtattttgagcaatcaggtgattgctgtccttgacatgggctattctcttttggaggactgcggctttacaagggctgaggctgtaagagctacaggccagcttgtgatgcgcaatatcgaaaacgtactcgaagcaggctgtgacggcgcactgaccgggccaatcgagagaaacgatattgaaacagtgaaaaagcacatcgcatgtatgcaaaatgacgatagcgatgatgtcagattgtacaaaatgcttggtacaaaactagtaaatattgctgaaaaaaagaatcctgataaggattacactcagatgatggaattgctaagaggctgacaataccgtgaatggttccaagtagttacaagaaacggattgttgcagaaagacagagggattggacaatgaaaaatacagtagtaacttttaaacaggcaaaggaaaagggcgagaagctcacgatgctcacagcatatgattattcgacagcaaagctcatagatgaggccggaatcaatgcaattttagtaggagattctctcggcatggtggtgcttggctatgaggatacactttcagtgactatggaggatatgattcatcacagcgcagctgtttcaagaggcataaaggatacgctgctcatcacagatatgccttttatgtcatatcagacatcggtttatgatgctgtagtcaatgcaggacgactcgtgaaggaaggccatgcgcaggcagtcaagctcgagggtggcaaggaggtatgtccacagataaaggctatcgtggatgcgtcaattccggtatgtgcacatttagggcttacaccacagtcagtaaatgcatttggcggcttcaaggtgcagggcaagggtgaagaggcagcgcagaagcttcttgacgaggcccgtgcggtcgaggaggcaggagcatttgcagtggtgctcgagtgcgtgccaaaggcacttgcaaaaaaaattacagagagcataagcatacctacaatcggtatcggagcgggagcagactgcgacggccaggtgcttgtatatcaggatatgcttgccatgtatgcaaacatgaagccgaaatttgtaaagcagtttgcacaggtcggaaaagaaatgaatgaggcgttcacagcctacaaaaaggctgttgaggagggaagcttccctggtgaggagcatacctttaagatggatgagacaataattgacaagctgtattagtatcgaaaatagtattgaagaatatttacaaaaaatagctacgaaaaataaaagaataaggagacataaaatgttaatatacggacaaatcgaacaggtaagagaagcagtaaaggcatggaaaaaagagggcaaaagcgttggctttgtacctacaatgggatacctccacgagggacacaagagcttaatcgatgcggcaagacgcgagaatgacaaggttgtagtgagtatttttgtaaatccaatgcagtttggccctgcagaggatttagacagctatccacgtgatttaaacagggatgcaaagctttgtgaggatgcgggcgttgacattattttccatcctgagcctgaggagatgtatgcagacggcttctgctcatatgtggatatgaatggcctcacaactgagctttgtggaaaaacaagacctatccattttagaggtgtgcagacagttgtcctgaagctgtttcacattgtgacacctgaccgtgcatactttggacagaaggatgcacagcagcttgcggtcataaagcgtatggtaaaggatttaaatgttgacacagaaatcatcggctgcccaatcatccgtgaggaggatggactggcaaagagctcaagaaacacatatttaagtgaggatgaaagacaggcagcgcttgtactgagcagaagcttaaaaatcggaaagcagctcgtagaggatggcgaaaagagtgcaaaagcgataaaggatgcaatcacagcagagataaacaaggagccgcttgcaagaattgattatgtagatgtggttgattttgaaacaattacaccggttgatgagattaagggaacaacactcgtggcaattgctgtctatatcggaaagacaaggctgattgacaattttattgcgtagacggacaagaaacgattattgaaaagaggtacaaacaatgaattatacaatgcttaagggcaaaatacacagagcggtggtcaagcaggctgacttaaactacgtgggaagcatcactgtagatacaaagctgcttgaggcagcaggcatcttggagtatgagatggtacagattgtcgatgtggaaaacggaaacagattcgagacctacaccatcgccggagagccgggctcaggcatgatatgcttaaacggcgcagccgccagacaggttgcagtcggtgaccatgtgatactcatgtgctatgcgcagatgacaccggaggaagcaaaggagcatcatccgaaggttgtgtttgtggatgatgaaaacaagatagcgcgtgtgacaaattatgagaagcatggaaagctgacggaggattttatttaacaatagaaaaatcaagtctgctgtagtataataatttatcgggtaaaatatcatgtatttatgcgggaggtaaatatgtacacagcagacgaaaagagatacgacacaatgagatataacagatgcggcaggagcggacttaagcttcctgttgtatcgcttggtctatggcacaatttcggtgatttttcatcgtatgacaacatgaagcagatgtgcttcacagcctttgaccatggcatcactcactttgacctggcaaacaactatggtcctgaatacggcagcgcagagaagcacttcgggcttatcctgaaggagcatctgtcagcataccgcgatgagctcatcatcagctcaaaggcaggctatgatatgtggaagggaccatacggcaactggggcagccgcaagtatctgattgcaagccttgatcagagccttaagagaatgggactcgactatgtggatattttctatcatcacagaatggaccctgagacaccgcttgaggaaacaatgggagcactcgaccagatagtaaaaagcggaaaagcactctatgtcggactgtcaaattatgacggcgagaccatgaagagagcctgcgagattcttactgatttgaaatgtccgtttatcatcaaccagaattcatacaatatcttcaaccgtacaatagagcaaaacggcttgaagcaggcagcaagagagtgtcaaaagggcatcatctccttcagcccgctcgcacagggcatgctcacagaccgttacataaacggtattccggaggatagccgtataaagacagacggccgctttttaaatcaggaaaagctcactccacacatcgagcagattaagaagctaaacgatatagccgcaaaacgtggtgagacactagcacagatggctcttaagtgggtggtaaaggatgatgacgtgacaagcgtgcttgtcggcgcctcaaagccacagcagattcttgaaaacttaaaggttatggagggcacaggcttctctgaggaagagcttaggatgattgatgaggttgtgggagtgtaaagatgaaatcagcagggagtatagcagtaattaatgctatactccctgctattatatttttggttgcaagaatcctgtttatgctataaaatatttataactgtatgcagatatttaataatcacaatatctgcctgtataataaaatacgcataaagaggacgaaagaatgatcaacaaattagtagacaaaatcaagaaaacaaacgcacctatcgtggtaggtcttgacccgatgctttcatatgtgcctgagcacatcacaaagaaggcatttgacgagcttggagagacaccggcaggtgcagcggaagctatctggcagtacaacaaggctattgttgatgctacatatgacctgattcctgcagtaaagccacagattgccatgtatgagcagtttggtgttgagggacttaaggcattccagaagacagtggattactgtcacgagaaggatctcgtggttatcggagacgtaaagcgtggagatatcggctcaacatcggctgcatatgccacaggacatctcggaagggtacagatcggcagcaagagctattctgcctttgatgaggattttgccactgtcaatccataccttggaacagacggtatcaagccattcgtagatgtatgcaaggaggagaagaagggtatcttcattcttgtaaagacatctaatccatcaagtggagagttccaggaccgtatgattgacaaacgcccgttatatgagtgggtaggcgagaaggttgcagagtggggagctgactgcatgggtgattcatacagctatgtaggtgcggttgtcggcgcaacataccctgagcagggtaagatccttcgtaaggtaatgccaaagagcttcatcctcgtaccgggctacggcgcacagggaggcaagggcgcagaccttgttcatttcttcaatgaggacggacttggtgcaattgtcaattcatcacgtggaatcatctgcgcatacaagcaggataagtacaaggatatgggcatcacagcagagaattttgcagatgcatcacgtaaggctgttgaggatatgattgaggatatctcaggagcacttgcaaatcgttaataagttattcagaaagcttaaatatattaacaaacgaaaccagggagataaaatggcagagaaatttgaggagattgcagttgtagttgaccagagctcactcggcaatggcatctacgacctcacacttaagacagacaaaattgcaaaggcagcaaaggcgggacagtttgtatcgatttactcaaacgacaagagtaagctgcttccgcgtccgataagcctttgcggcataaacagagatgatgacaccatccgtctcgtgtaccgtgtgacaggtgaaggcacgggaacagaggagttttcaaagcttgtcaggggcgataaggtaaggattttaggacctcttggaaacggctttacagtacagccgggaaagaaggccttccttatcggcggaggaatcggagtgccgcctatgctgcagcttgcgaaggatataaatgcaggcattgtgcagacatcaggtgaagaaaaaaatccggcacaggcaggtgcagtatgcgatatgaacatcgtcatgggctatcgcgatgagaataccttcctgctcgatgagtttaaggaacaggcagcttcctttgtagctacagaggacggcagtgtcggcacaaagggcaatgtcatcgatgcaataaaggagaatgctcttgaggcagacgtgatttatgcatgtggacctatgcctatgcttcgtgcactcaaggcttacgctgcagagcatgatatggactgctttatatcaatggaggagcgcatggcatgtggaatcggtgcatgccttgcgtgcgtatgcaaaacaaaggacaaggatgcccacagcaatgtaaacaacaagcgtatatgcaaagagggacctgtttttgatgcgaaggaggtggagctgtaatgagcaatatgtcagtaaaggtggccggcgttgagtggaaaaatcctgttacagttgcatccggcacattcggctcaggtgcagagtacagcgagtttgttgatttaaacagacttggtgcagtcaccacaaagggtgttgcgaataagccgtgggagggtaatcccacaccgagagtagctgaggtgtacggtggcatgctcaatgcagtcggacttcaaaatcccggcatcgagcttttctgcaagagggatattccttttttaaagcagtttgacacaaggattgtggtaaatgtctgcggtcattcgctagatgagtatcttgatgtggtaaagcgtcttgcagatgagcctattgatatgatggaaataaatatctcatgcccaaatgtaaaggagggcggaattgccttcggaacagatccaaagggtgttgagaccatcacaagcgagattaaaaaatatgcaaagcagcctgttatcatgaagctttctccaaatgtcacaagcattgcagagatagcaagggctgcagaggcaggcggtgctgatgcggtttcactcatcaatacaataaccggcatgaagattgatataaacagaagaagctttgtgctggcaaacaagacaggcggcatgagcggtccggctgtgcatccggttgcagtgcgcatggtttacgagacagcacatgcagtcaatatcccgattatcggaatgggcggtatcacaaacgcttccgatgccatagagatgatacttgccggagctacagcagtttcagtcggcacagcaaactttgtgaatccaaagaccacagagcagatagtggatggcatcgcagagtacatggacaagtatggagtaaaggatatttcagagcttgtcggtgcggttgacagatagagcataagggatagacggaggagaaaataatgattctggcagcagattacgtgccttctatgtatgccacagtctgggcgcttgtaccacctgttgtggctatagttctggcacttattacaaaggaggtctacagctcattattcgttggaatagtgatcggcggactgttttatggaaatgtatttcagtctggtttttcagctgagagatcagtgcttcacatattcgaggacgggcttgtcggagtgctatcggatccggacaatgtgggaatactgatatttttagtcgtgctcggtgtcatggtgagcatgatgaacaaggcaggcggctcggcggcctttggagaatgggctagtgagcacataaagacaagaatcggtgcccagcttgcagctataatgcttggagtgctcatatttatagatgattacttcaactgtctgacagtgggaagtgtgatgcgccctgtcaccgacaagcatcaggtttccagagcaaagcttgcatatctgatagatgccacagcagcgcctgtgtgcatcatcgcacctatatcatcgtgggcagccgcagtcacaggctttgtaaagggagaggatggcttttctattttcataaaggccattccatacaattactatgcgctctttacaattgtcgccatggtgacaattgttatcttgcaggtggatttcggtccgatggcaaagcatgaagccaatgccaaaaagggcgatttatttaccacaggagacagaccttatgcagagtcaaagcaggatgtgataaagggcaagggaaaggttatagaccttgtatttcctatactggtgctcataatatgctgcatcataggaatgatatacacaggaggcttttttgacggaacaggctttgtcgatgcgtttgcaggcagcaatgcgtcgattggtcttatgctcggaagcttctttgcactgataatcaccatatgcttttactcaatcagaagggtgctaagctttacggattgctgtaattcaatccctgagggctttaaggcgatggtacctgcaatacttatactgacctttgcatggacactaaagaccatgacagaaagccttggtgccaaggaatttgtcgcaggcttggtgggaggcgtatcaggaccactccttggactgttcccggcaatcatattcctggtgggagccttccttgcttttgcaacaggaacctcatggggcaccttcggcatactcataccgatagtagtaaacatcttctcaggcacaaaccatacgatgatgatcatctcaatctcagcatgtatggcaggtgcagtatgcggagaccactgctcaccgatatccgataccaccatcatggcatctgccggagcccagtgcaaccatatgaaccatgtgtccacacagcttccgtacgctgtgcttgtggctgccgtatcgtgcctgacctacatcatagcaggctttgtcagaaatcctatagtaccttttatcataggagtgcttatcctgattggaacctttgtcggaatcaagtatatcatcaagtatatcacgagaaccgataaagcaaatgaacaggcggagtagccaaagggagaccaaaaagagttctatttttcacagactttgtgtctgcgaatgatagaactctttttttatagtaaattctataccggacggacgactgtgcagtcgtctgttggctatcaataaaatttatagcccgctaacaaatattaataaccctaattacatttacaaaaatatcaattagtggtaacatatcaataacttagaaatcatatttgaatggtaggaaatcccaaccatacaaactaagatcaaactcataatatactcaaaacaaacattaacaaaaaaagaggtaatatcaatggcaaaaattgcaaagcagctcactgagctgataggtcatactccgcttctggagctgaccaattatgaaaaagcccttgggcttgaagcaaaaatcatagcaaagctggagtatttcaatccacttggaagtgtaaaggacagggtggcggcagctatgatagaacagggcataaaggatggaaagataaatcaggacacaataatcatagagccgacaagtggcaataccggaatcggacttgcatttgtggcagcatcaaagggacttcacctgatacttataatgcctgataccatgagcgttgagagaagaaaaatcgtcacagcgcttggcgcagagataaagctcacaccggggcgtgagggcatgaagggtgcaatcgatgaggcgcagagacttaaagagcattatggcaatgcctttattccacagcagtttgagaatcaggcaaatccggatatccacagagctacaaccgctcaggaaatctgggaggatacagatggaaaggtagatatctttgtatcatctgtcggaacaggcggcacctgtacaggcaccgggcttggattaagagaccataatcctgatgtaaggatagtagctgttgaaccaaagagctcaccggtactctcaggcggaagaccggggcctcacaagatacagggaatcggtgcagggtttattccaaaggtcatgcgcatggatatagtggatgaggtgattccggtggagaatgaggccgcttttgacaaggcaagagaggttgcaaagagcgacggacttctcgttggcatatcctcaggagcagcaatatatgcggcaacagagcttgcgaaaagacctgagaacaagggaaagaatatcgtggtgctgcttccggatacaggagaaagatacctgtccacaccgctttttacagtaaactaatggcatataaactgacggcataagcttactttgccggaaactgtaacatgaaaaatgagaaacatacatgagaaacatacaaaaatatacggcagccctgctgtcgacagtgatgattctgtcgcttcttctgacaggctgctcaggcaggaaggatgacggcacagtcaccataaccaatgtgtcgtatgatccgacacgagagttttacgagaaatacaacaaaatattcgagtcttactatgagagcgagcacggcaaaaagataaatgtgattcagtcacatggcggctcgggagcacaggcacgctcggttgtggagggctgtaatgcagatgttgtcacactggcactcgagcatgacatagacctgatacaaaataccggcttaattgataagggctggattgatgagttttctgacagctcggcaccatacacatcaacaatcgttttacttgtaagaaagggcaatccaaagcatataagtgactgggatgacctggtgaaaaagaatgtggatgtgattacgcctgatccaaagagtagtggcggagcctgctggaattttcttgcagcactaagctatgcgaagacaaattatgacagcctaaaggaacagaaatcgtttatgaagaagctgtatgaaaatgtcacaattatggattcgggtgcgagaggctcaacaaccacatttgtggaaaacggtcagggagatgtgctcatagcgtgggaaaacgaggcacttacgaccatggattcatatccgggcaagtatgagatagtgaatccgtcagtcagcatcttagcacagccctctgttgctattgtggatgacaatgcaaagagcaacggaacacaagaggtaagcaaagaatacctacagtatctctacagtgatgaggcacagcagctgattggcgaaagcggctacagaccaaccaatcaggatatattaaaccggttttccgacaagtttgatttaaatatcaggctttggagcatagaggattacggcggatgggatgaagcctacaagacatatttcgatgatggagcaatgttcgatgaaatttacggcaactgataaaacagcaaaaaagaaaactaaatcaaagaacataaagaccagagttataccgggctaccatctttcgcttggaatagtggtcacgatgctttcagtcatcgttctcattccgttagcatcagtgcttgtgtattcgctaaagatatcgccgggcgattttgtggcacttatcatgaaggagaatgtgaggaatgcctttatcacaagcatcacctcatcatttatcgcagcaatcgtaaatgtggtatttggactcatagtggcatggacacttgtaaagtacgattttcccgggaaatggctgcttgacggacttatagagcttccgtttgcactgccgacagcggttgcgggcatcacgctctcaaagctgtactcaggcacaggcttttttggtaagggccttggcaagcttggaatagatgtggcttacacacaggcaggaatagttgtggcacttgtttttgtaggcattcccttcgtaataagagctgtacagccggtgcttgaaaagatggataatacatatgaggaggctgcttatatgcttggcgccacaccctataagacattttttagggtaatacttccggagcttcgcccggcactcttaacaggctttggtcttgcatttgccagaggcataggagagtacggaagcgtcatctacatatcaggcaacagtgcaaggcacaggacgcaggtggtatcctacgtcatcatgcagaagcttagctatatagattatgccagcgcgactgccatagcacttgtgatgcttatcatatcatttttactgctgctatttgtaaatatagtgcaggttaaacagtcacagcgcactaatttgttgtagaaggctgcatataaatcaaatgcgatgcatacaaacaggaaaggagcacaatgcgatgaacgaacaggtaaagcttgaaagaagaaaaaagatcacaaagataatactcgtcactgttacagtgctcttcatatttgtcatgcttgtagttccgcttttttctgtgatggcaagtgccttaaaggaggggcttggattctatctgaaagctatctcaacaagctacgtgctttcagcactcaaggtgactttgatagcaacagtttttgcggtagttatcaacacattctttggaatatggacagcgtggctgttgaccaggttttcgtttaaaggaaaacaggtgcttgcaacacttattgatataccgttttctatttctccggtcatcgtaggacttgcgtatcttatgaccttcggacggcttgggtggttttatccggttatcagatggtttaatgagatattcggcacgaatgtgagaatcacctttgcaataccgggagttgtgcttgctacgatatttgtcacgtttccgtatgtgtcaagggaaattataccggtgctcaatgcagagggaaaggatgaggaagaagccgcagcgctgatgggagcatccggctttacgatatttcggaaaataacacttccgcagatgaagtggagcctgatttatggaatcatactctgtacggcgagagccctcggcgagttcggtgcggtaaatgcgctctcgaagacaagaggcgagacatttacactgccgcttgagattgatgccttgtatatgtcgggcacagacagctcgataacatcggcatttgctgtatcgtcgatactgttaattattgcattaatcattctttttgcaagaaatatagttgagcataaatttaagaaattacactgagatatgcttggaaaatatgatttacactaataaaatctgctgcaagggaaaagcaggaaggagataacgtatatgtacgttgagatgaaaaatatatacaaaaaatacggagacttcctggcatccgataatgtgagctttggagtggaaaagggaaagcttgtggcgctgcttggtccgtccggcagtggcaagacaacacttcttcgtatgatagcagggcttgagacgccaaattcaggtgacatatatatagatggaaagcgagtgaatgatattccggcctcgaagagaggcataggctttgtgtttcagaactatgcgctgtttagatacatgacaatatacgacaatgtggcatttgggctggagcttcagaagatgccgaaaaagctcataaaggagcgtgttacaaagcttcttgagatgacaggcttgtcggggcttgaaaagagatatccgaatcagctttccggaggacaacgtcagagagtggcatttgcaagggcgctggcgccgaatccacaggtgcttttactggatgagccatttgccgcgatagatgcaaaggtgcgaggtgagcttcgtacctggctgaaggagctggtcgaaaagcttggaatcacaagcattttcgtcacacatgaccaggatgaggctgttgaggtggcagatgaaatcattatcacaaaccacggcacgatagagcagatgggtacacctcttgagatatacaagtcgcctgatacaccttttgtggcgcagtttataggacacaccacagtcgttgaaaactatgacaggctaaagggctttgacaggatagaaaatgccgacaaggcggtaatcagacctgagtttatcaagatatcaaagagcggcaacttagaccgctatcagtcagcggcagaggagggcatcgttacagatgtggtattcagaggaaacaggatggatatcacagtaagcataaacggcatcgaggtgattggcgagcgctcacttgaaaaggacctgatagcagtcggagagaaagtacatgtgctgatttacaggctgtatatatttgatgaagagaaaacatacctgatggaaaacagcgaaatgcaggagcaggatgtattctacatttagatataggaatagtctaaagcttgtgattgaaagaggaagcagagggagataaatgaagatagaaaacaaaaaaatcctacacacggacatcctcataataggaggtggcacggcgggctgttatgcagcgctcaccatccgtgagaaatcggattattcgattataattgcagagaaagcgaacataaagcgaagcggatgccttgcagcaggtgtcaatgcgataaatgcatacatagtaaagggcagaaagcctgaggactatgtagactacgcaaaaaaggatgctgacggcatagtaagggaagacttactcatgactatgtccgagggtttaaatcgtgtgacggacaagatggaaaagcttggacttgtcatattaaaggatgaaaacggtgagtatgtagcaagaggaaaccgaaatatcaagataaacggcgagaacatgaagccgcttttggcagaagctgtatcaaagcttacggactgtacagtgataaacagaatcaatatcacggactatatagttgagaacaacaccataaagggtgcatacggattttcaatcgaggatgctacagcctatgaaatcagggctaaaaaggtgctctgtgctacaggcggagcggccggtttatacagaccaaacaatcccggcttttcaaggcacaagatgtggtatccacctttcaacacaggcgccggatatgcgatgggcataagaagtggagctgagatgaccacctttgagatgagatttatcgcactcagatgcaaggacacaatcgcaccgacaggaaccattgcacagggagtcggggcaaagcaggtcaattctcttggagaggtttacgagacaaaatacggccttaccacatcagagcgtgtatacggaacggtcatggaaaatctcgagggaagagggccttgctacttaaggacagagggcatttcgccacagcaggatgagtcattaagaaaggcatatctcaacatggcaccaagccagacactcaagtgggtggaggcaggtaagaatccaagtgagcagaatgtggagatagagggcaccgagccgtatatcgtaggtgggcacacagcgagcggctactgggtaaataccgagcgtgagactacaatccacggactttatgctgctggagatgtggcaggaggatgtccacagaaatacgttacaggagctatggtagagggtgaaattgctgcgatagatatggtttcaaagcttgatgcagatacctccgatggaagtcttggcacatcggcatttgatgagaaaaaggcgcttgacgcaaaagcttcagagtacgaccatttcctcactgaaaggtctcagatgtttacaacagaggcaatcgaggaagccatgcagaaggtcatggacaactacgcaggcggtatttccacacattatcagttcaacggcaagcagcttgccctggcaaaggaaaagataaatcatctgatagagctgaccggtgatttatatgcatcggatatgcatgagcttatgttcatatatgagcttaaggagaggcttacggtatgtctttcggtcatagcacatcttggtgcaagaaaggaaaccagatggcacagctttgccgagaatctggattatccgggcaagagtgatgactggatgaaatacgtcaattccagatacgaaaacgggcagcttcatatgatttacagagagcttgtcggaagggaggcgcgttatgagcataatgattgataaagcaaagtgtaagggctgtggcatgtgtacaagtgtatgcccgggaagcctgatatatcaggactcagagaaaaaagcttttatcaaatatcctaaggactgctggggctgtgcctcatgcatcaaggaatgtcattttggcgctattgctctttatcttggagcagacataggaggcatgggaagtctcatgacagtaaaaagcacaccggatacgctgacctggaatatcaaaaagcgcgacggaagcagggaagagattcttatcaacaagaaggaatccaataaatattaaagaaaaggatggtaacagacatgggtgaattatcacatcttgacgaactcgaagcagaggcaatatacataatacgtgaagtagccgcagagtgcgagaagccggttatgttgtactcaattggaaaggacagctcggtaatgcttcatcttgcaatgaaggcattttatccggagaagccgccatttccgtttttacatgtaaatacaacctggaaattccatgagatgatagaattcagagatcgcattgctaaggaaaagggcatcgagatgcttgaatatataaatcaggatggcgtaaagcagggaatcaatccatttgaccacggctcagcatacacagatatcatgaagacacaggcgcttaagcaggcgctcgacaaatacggctttacagcagcgtttggcggcggccgaagagacgaggagaaatcaagagccaaggagcgaatcttctccttcagaaatgaaaaccacgcatgggatccaaagaaccagcgcccggagatgtggaagctctacaactccagaatcaaaaagggccaggaggtgcgagttttcccactgtcaaactggacagagaaggatatctggcagtatataaagagagagaatatcgagattccttcactttactttgcaaaggaaagacctgttgtatacagagacggcaacatcatcatggtagatgacgacagaatgaagcttcgtccgggtgagaaaatccagatgaagagtgtacgtttcagaactctcggctgctatccactgacaggtggtgtggagtcgacagcggatacacttgatgagattattgatgagacactcagtgctgtttcctcagagagaaccacccgtgtcatagacaacgaggcggcaggcagcatggaaagaagaaagagggagggatatttctaaaatgagcggattacttaaatttattacatgcggaagcgtggacgacggaaaatcaactctgatcggacatatattatacgattcaaaactgctctatgcagatcaggaaaaggcattggagcttgacagtaaggtcggaagccgtggcggcgccatcgactattcactcctcctcgacggactgatggcagagagagagcagggaatcacaatcgatgtggcttatcgttacttcacaacagataagagaagctttatcgtggcagatacaccgggccatgaggagtacacaagaaacatggctgtaggtgcatcctttgcagaccttgcggtaattttaatagatgcaaagcagggcgtattggttcagacaagaagacacgcaagaatctgcgcgctcatgggaatcaactactttgtatttgctgtaaacaagatggatcttgtaggctacgacgagaagcgtttcgatgaaatcacaaagcagattattgagcttacaaaggagcttgaactcaaaaatgtagtaataattcctgtttctgcaacagagggtgacaatgtcacaacaaagtctgagaatatcccatggtacaagggacctgctctcttatcataccttgaggatgttgacataaaggatgagaacgaggaagagggcttttacatgcctgtacagagagtctgccgtcctgaccacaccttccgtggattccagggccagatagaggccggagaggtaaaggttggcgatgaaatcaccacactgccaagcaatgagactgcccatgtaaagagcatccatgtgggtgataagctaagcgatagcgcatttacaggccagccggttacaatacagcttgacagagaggtggacgtatcaagaggctgcgtgctcacaatcggttcaggagcaaaggttgcttcatctatcacagctacaatactctggatggatgacgatgagctcttcaagggaaagaatttcttcttcaagcttggtaccaagtcaataccgggcatcgtaacagagatagagcataccatcgacgtaaacacaggtgaggaaaagcctgccgacaagctcaaaaagaacgagatagcagttgtaaagattgcgttctcggacaagatagtctgcgataagttcaaaaaccacaagacactcggtgagttcatcttaatcgaccgtgtgacggatatgacatctgcctgtggtgtggttgaagaggtacacacagaggaaagcggcctctatgagggcagagtagacaggaacgtaagagctgcaatcaagggccagaaggcaatcaccgccgtattcgtagacggagtggatggtgtaaaccgcggctttgtggaggatgtcgagaaagccttaaatatagacggacgccatacttatctctacgcaccaaaggagggtgaggacttcgtaaatgtagtcaagcatctaagccatgccggaatactcgtacttctgctcatcagccaaaagcaggagaaggagcttgcagccgacaaagttgagttcacaaaggactggaacaaaaacggcatagatgtggacaaggctgcggagtttatcaaaaagcagtcagtatatgacggagtgattgtaaacacaagtgagtatatctgataaaagggtacttgatttctcaagtaccctcatgtctaatctacttagaaagtgaatcggatatgactccgatttgccctcagtgctaaaatgttataagaatagcatcctaaactttggacggtgtgggatgctatttctttttattattattatgattgtctatgtatgacagagccgcaaaaacaactaatatttccacattgaaaagcacgccccaatgtggtaaaattgacaaagataatttaaagaaaaacacacaggaggattaacatacaatggaaagctataagagcgaatttatagactttatggtggagagtgacgtgctgaaatttggtgatttcacattaaagagcggccgtaaatcaccatttttcatgaatgcgggagcatatgtgacaggttcacagcttaagagactcggagagtactacgcaaaggcaatccatgcaaactacggagatgactttgatgtattattcggacctgcatacaagggaattccgcttgcagtggtaacagctatcgcataccatgagctctatggcaaagaggtgcgctactgctcagacagaaaagaggcaaaggatcacggtgcagacaagggaggcttccttggaagcaagcttaaggatggcgacagagtagtcatgatagaggatgtcaccacatccggcaaatcaatggaggagacagttccaaaggtaagagaggctgctgatgtcacaatcgtaggccttatggtgagccttaacagaatggaagtcggacagggcggcaaggtgagcgcgctcgacgaaatccatgagaagtacggctttgagggcaaggcaatcgttacaatggaagaggtcacagagtatctctacaacagagagcatgatggcagagtagtcattgatgacacaatcaaagcagctatagatgagtactataagcagtacggctgcaaataggagaatataaattgcttggcagaagaaaacgtaacaggtataagtttacggaaaagaagcaatctaagagggggatagctgcacttgttgtggctatcctcatagagattgtatatatagtttttttgaatgcggcattcagaggagatggcaatctgtctatgtactatggcagtgccggtatactgatgcttggcatatctctggcagatttcgggtttgccatcagaagcctctttgatgaggaatcattcatgacatttccacgactggcagtgtttttttcactcatagcggtaatcagctggggaggaacatatgctgcaggttttattatatgaaagaaagattatagggatatatgagttataaagagatttatgagctctccaatgagctttacgcagagcgattagagcttgtggaggagcggatagaacagatcgtcagagagcctgcgatagagccggcttttgcagattatttcacaagtgtggcaaagtgcctaaacactattaaaaaccatagcgcagataaggaatttaacgatttattctattcacagtttgataaagaaaattacgagaaaagctatgccaacccggcatacgccgtaaaggtgctcggagatgagtatggtcagcttttatcggctgtatatgcaaaaattgccggaagcattacacatatctatcagggggatataaaatatctctgcatttatgcagagcttattgtagagctttacaattattttgagaatgccaatgagctgagtcctgatgagataaggggctgtatatattcgttcatgcatgattatgaggagatttttgcagaggatgacaacagagcactccttgacccggcttatgattactatacagagcttgtaaatgaggcagatttgtcaaatgatgattatctgtattcctacggactgtatgtcggagagaatgagcgcgccggcagagcgcatctggcttcattttcagatgaggagatacaggccatggcagatacctatacagaaggataccgcattggctttattacctgcaacaaggatatctcaaagaagtcggtggttcaggtgctttatccgcttggctttgagcgtatgataagagcagcattaaaaaatttcgagaaaatgggtatgaagcctgccatgagaccattttccacatcggtcaataagcagtttgactatgaccacaaggaggatatggcactgtggcttgacaaggcatatgtggagtatcgtcttgagtgcatgcacaatgcacttgagagaatgaaggatgtagcatgcaaatgtggaggaccggctgtcatagagatatttggagaggagccgtttgctccggtttcaaagaaggaggctgcgcactttaatgatgagcagcagaagcttgtagtccatatgacaagcgtgcgctcacagtatatgaacagctatatccacagcgaggacagaagctttacgattattgcctatccgtgtgctgcaatcggacctgattataaggaaatttttacggagactgtaaagattaatactcttgattatgcactctacagggatatgcagcagaaaatcatagatgtgctcgatacagcagacagggtgcatatcgtcggaacaaacggcaacaggacagatttgtatgtcaagattcatgagcttaatgagccttcaaaggagacggcttttgaaaactgtgtggctgatgtaaatatccctgtcggagaggtgtttacttcaccggtgttagagggcacaaacggtaagctgcatgtcagtcaggtatatctcaatgagcttaatttccttaatctggaaatcgactttaaggatggcatgattgataaatatacatgtaccaattttgaggatgaggaagaaaacagaaagtatatatcagacaatgtgcttttccatcacgacacactgcctatgggtgagtttgccataggcaccaatacgacagcctaccgtatggcaagagtatacgatatcgcggcaaagatgcctattctcatagcagagaagacaggaccgcactttgcagtgggtgatacctgctacacatacgatgaggacaatatgacatacaaccctgacggaaaagcaatcattgccagggacaattcagtttccatccgcaggaaagatgatatatcaaaggcatatttcaactgccacacggatatcacaataccatatgatgagcttggagccatcacagttattcgacacgatggctcaacctgtgatataataagagatggcagatttgtgcttgagggcgtagaagagttgaacaaaccgctcgatacgcttgatgctgaaagtaaataattgttagacatataaggaggataaaatggcaaaagtaggaatagttatgggcagcgactcagatttaaaggtgatgagtaaggcagcagatatgcttgaagagctcggaatagagtatgagctcaccatcatctcggcacaccgtgagccggatgagcttattgagtggacaagaggcgcttgtgatagagatgtaaaggtaataatagcaggagctggaatggcagcagcacttccgggaatgtgtgcagcgctttttgcacttcctgttatcggagtaccgctttcaggaaagaatctggatggaatggatgcagtgttctcaatcatgcagatgccacctggagtgcctgttgccacagttgcaattgacggtgcgaaaaatgcagcaatccttgcagcaaagatactcgcagcaggtgatgatgcaatccttgagaaaatcaaaaagtatacagcagatatgaaggctcaggttgtagcaaaggatgcgaaactgaaacaggttggatataagcagtatcttgctgaaaaatagattgtattgtcatctataggagggtttttatgggtatattgcaaaaggcagacagatgtatggatgaggcagcagccttatttggcgagaataagctttttttggcagagaagaaggcacaggagacagccggtctttataagagctgtggcgcatatgagcagatggcaaagactgtcaatcttatgggagtcatatatgcatctattggagatgtaagcatgtcgattgactgctacctggaggctatggatgtagctgtggagcagggctcaacagagataataatgcttgttaacaataatataggctcactctatatggagcttggattgtatgagaaggctgtcagatattttaacgaagcactggagctgtgcaagccaccgctgcatggagagagggataactattatcaggagcttctcatgcttcatctgaatctgtgcatatcatacacaggaattaatgagtttgaaaaggcagaaaagcatctttctgacgcgatactccttaatgatatagctggcagtgataaaaacagatttctgatagacatgtcacaggcacatctgctatggaagatgggaaatgaggatgaggtcagagatcatgtggaagagctggttgagggtgcgataaacaatatcgattctgccgattatgtgcttgagatactaagtctttgcaatctatttatgaatatgggggagttcgatgcatggaaaaagattattgtggagtatgaaagatttgccactgatacgcaaaatctgtttttccagaagacctgtgtcaagatgtggatgaaatatgagagagccatgggtgatacagaggcatacaacaagctgtgcgtatattacgcaaatctccactctatgcaggtgaaggagcagataaagcgtcttggtgatacaatagaccttaagcttcagcttcaggagactgagtatgagcgccgtaaggcagtcagactcaactacacagatatgcttacaggcatgggcaataagttcaagatgcgaaacgattttgaaaagcttgtgagcaaaaatcaggattcagatggtgcaggaatcacgtttggagtagtggatatagatttcttcaagtcatttaacaaaaacagtggcagagtcaccggtgatgcagtgctaaaagaagtgtcatccataataaatgagagcgtcagagataatggaatggggtatcatttctatggtgatgaattctacataatcctgcaggaaacggatgaggatatcattaaaaatatagctgaacatataagacttgagcttgccaaaaaacagatacttcatgagagctctaaggtggatgagtatctgactgtatcacaggcatatgttaccgccccggatgtaaaggtgccggatgagttttcaaagctgttcaagacggtggatgaagtgctcaatgatgtgaaggaaaatggcagaaatgcatataagatagtctgatgctttaagcgtataagacaactataaaatgacacgcagcgtaaaacgttgcgtgtcatttttaatggatctatatatacagttatagttatatttgtacttatacttatatttatagttatatttgtacttatacttttatatggctatattgtctcatttatattccggatataacaatatcagtgcctgctttctcatatatatctgctgtctcaggtgagataccggagtcggtgattaccatattgatgtcatcaagcgaggcatagcttgatatggatgtggtatcaaacttggtgtggtctacaagagccacagttttagcggaggccttgatacacatgcgcttcaaatcagcctcgtatatactgaaatcagtcagtccgtcttctacagagaagcctcttgctgacacgaacgcgatatctgtgtgtatctttttgagtaaatcaacgccaagcagtccttctatggaagcggatgcactggttacgataccgcctgtcaggatgactgtgacaccggggatatcctttagctctaaagccagattgatgccattggtgatgacggtcagctctgtaaagcctgaaagcttcatgccgagagtgtaggctgtggagctggcatcaaggaagatacacatatggtcgctcacgagctttattgcctcgtttgcaatctcctccttggcctccttgttttcaagagcgcggtcatggaacagataggccctcgatgttaaatcagtcatgtcatgggttttatccttgtagatagcaccgccgtgagtctttgtcaggagcttttccttatccatctggtttaaatctgttcttatagtagtggtcgatacaccaagcagctcgctgagctcattggtggtagctttccggttttcttttaaataatcgagaatcttttgttgtctttctaattgcagcatagattttcctctttcttttgatttctgttgtaattttacgtacatatttttttcacaaagcattgtataaatatataataactcaaataagtaaataaagccagtattttcaattatttatgtttgcttttgtttggtgatatttaattacatttatttttacttttatttgcttttgctattgcatttatgcttttgaagtgttatatttatatcatcaaataaaagcaaacgcaaatcatacaagacggaggtattattaaatgaagtttttcgtagatacagcaaatgtcgaggacattaagaaagcaaacgatatgggagtcatctgtggagttacaacaaacccttcactcatcgcaaaagagggcagagatttcaatgaggtaattaaagaaatcacatctatcgttgacggaccgataagcggagaggtaaaagccacaacagttgatgcagagggcatgataaaagaaggacgtgaaatcgcagctatccatccaaacatggtagttaagattcctatgacagttgagggacttaaggctgtcaaggtactttcatcagagggcatcaagacaaacgttactcttattttttcagcaaatcaggcaattcttgctgcaaatgcaggtgctacatatgtttcacctttccttggcagacttgatgatatcagccagccgggcattgagctgatcagacagatttcagagatttttgatatctatggatatgatacagagattattgcagcttcaatcagaaacccaattcatgtcacagactgtgcacttgcaggagctgatatcgcaacaattccttacaaggttatcgagcagatgacaaagcatccacttacagatcagggaatcgagaagttccaggctgattacagagctgtatttggggattagatattataaaccaaagacaggtataaatattttatttcatgtcatagatttaacaggagaacaaaatgaacaaattagagcttcagattacagcaaatgaagtcaggaagggtatcgtcacggctgtgcattctgcaaaggcgggacatccgggcggctcactttctgcagcagatatatttacatatctgtattttgaggagatgaacattgatccaaagaatcctaaaaagccggatagagaccgctttgtgctttcaaagggacacacggctccgggactttactctgcacttgcgcagagaggctattttccggttgaggatttaaagacactcagacatctgggatcatatctgcagggacatcctgacatgaagcatatcccgggtgtggatatgtcgagcggttcgctcggacagggcatttctgcggcagtgggcatggcactttctgcaaagcttacaaatgatgattacagagtatatacacttctcggcgatggcgagattcaggagggacaggtttgggaggctgccatgtttgcgggcttcagaaagcttgataaccttgttgttatagttgataacaacggacttcagattgatggaccagtggatcaggtgtgctcaccatatcctattggtgagaaattcaaggcattcaatttccatgtgattgatctgaaggatggaaatgacatggatcagattgctgacgcatttaaagaggcaaggaatacaaagggtatgccgacggcaattatagcacataccgtaaagggcaagggtgtttcatttatggaaaatcaggtcggctggcatggcaaggctcctaatgatgaggagtatgcagttgccatggaggatctgagaaaggaaggtgaagcattatgtcagaagtaaagaaaatcgccacacgtgtcagctacggaaatgcacttgtagagcttgcaaaggagcacgatgacgtatatgttcttgatgctgaccttgcggctgccacacagacagccatcttcaaaaaggaatttccagatcgtcacatagactgtggtattgcagagtgcaatatgatgggtatcgctgcaggaatcgcagcaacgggaaaggtgccttttgccagttcctttgccatgtttgcggcaggacgtgcgtttgagcaggtgagaaactctattggatatcctcatctcaatgtgaaaataggtgcgacacacgcaggtatttcggtaggagaggatggagccacccaccagtgcaacgaggatattgcactcatgagagcaattcctggcatggttgtaataaacccaagtgatgatatagaggcaaaagccgctgtaaaggcagcttatgagtatgagggtcctgtatacatgaggtttggccgtcttgcaacaccgataataaatgacaatgcagagtataaatttgaaatcggaaagggtgttacactccgtgagggaacggatgtagctatcatagctaccggtctgtgcgtggcagagtcacttgcggcggcagaaaagcttgcagcagatggagtaaatgcaaaggtcataaatatacacactatcaagcctcttgatgaggagcttgttgtagctgcagcgaaggaatgcggcagggtggttactgtggaggagcactctgtaataggaggactcggagccgcggtatgtgagacactttcgcgcaaggctccaacaccggtaaagacaataggcatacaggactgctttggtgagtcaggtcctgctgtagctttgcttaagaaatacggacttgatgcagagggcatttatgcatcagtgaaggattttttataagtatttaaaatagtttggttttatgatttttcatattttccctaatataataataaactaataaaagaaaggacagccgggatacggttgtcctttcttctactttgtatacatataaaaactttaatgttttaattagtgtaaaataatttaataaaatttaaaatatatattgtgttatagatttttatctgatatattaaatctataaatgctgggcgagcgtaactattaatttgatacatatatatgtatcagcttaaatgaaacatgtgattgattcacagggaggaaatcatgataaggaatggaaagaagaaggccatttcgtgtgcactcgtcgcagctatgtcggtaggacttgcggcgtgtggaacaacaagctatgactttaaggtcagctacgatggaataaaaacaggggatgtttcatcgaaagtatcggttcatgatccgtcaatacttaaggcggatggtgaatactatatctttggttcccatatgtctgcagcaaaaagcagtgacctgttaaactgggaaaaggttgctgatggatattcaaagaaaaatcctgtatacggacagatatatgatgtggcagatgaagcctttgcgtattctggaagcaagaactcattgataaagacggatgataaacaggtgcatgtgtgggcaccggatgtaatctacaatgagacaacaggactttactacatgtattattgtacgacatccacatggaatgcatcaaatctgtgctatggcacatcaacaacacctgagggaccgtatgaatggcagggggctttgatatactcaggcttcaacagaaagacgatttcaggtacagatgtgcttgactatgtggatgaggattatgcttacaagaactatatcaagggggcgcagtacaattatgaggactatccgaatgcgatagatccgactgtgttttatgatgcggatggcagaatgtggatggtatatggttcatggagcggcggaatatttttgttggaaattgacaagacaacaggacttgttatccatcctgaagcagataaagcaaacaatgtggatccgtattatggaaagcgtcttttgggaggaggtcatatttcgattgagggcccatatatcatgtatgatgagacaagcggttattattatctgtttgtgtcgtatggagctctgacaagcaatggaggctatcaggtcagagtattccgttcaaagacagtcgatggtgaatatgtggatatgaatggcaaatatcctgaaaaaagtgcacaacaccagaatttcggactgaagctcacaggcaactataagcttccgagccttgaaaaagcatatatggcaacgggacataattcggcctttgtggatgacgacggcaggatgtatctggtttatcataccagatttaacgataatggagagggacattcaccgagagtacatcagatgcttgttaatgaggatggctggccatgtgagctgccttatcagacgcagggagagactgttaataaggatggttacgacatcgatgatattatcggacgatactatgttataaaccagggaacggcaatagattcaaaaattgcaaatccggtgattctttatcttgagaaaaacggaaaggtaaagggagaaaagtcagagggtacctgggagtgcaaggatggctcatactatatgaatatcactatagacggtaaaaaatattccggtgtattctgtcaaatgaaggatgaggctggaagtgatgtgatgacattttctgctgttggcgaaaacaagagcgtctggggcgtgaaatatttatagttacgtttcaaattaggcagatatgtaaatagttagatagtaacaacattggaatagatggagaaaaaaatggataatacattaaaatataatgaaccatggatactgcagagagcagatccatatgtatacagacatacagacggagcatattactttacagcgtcggtaccggaatatgacaggattgtacttagaaaatcagatacgcttgcaggacttgagacagcggatgagaatgaaatctggcacaagcatgagagtggaccgcagagcatacatatatgggcgccggagcttcattatctgtttggaaaatggtatatttactatgcaggcggtgataaggatgatatctgggcaataaggccgtatgtattggaatgtcagggggatgacccggttaatgataactggattgagaaaggcaagatgcaaagagcagatggggatgagttttcgtttgaagcattttcacttgatgcaacagtttttgaagtgaacaatgtgtggtactatatctgggcagagaaggtcggagtaggaaagcagatttcaaacctgtatatagcacgcatgaaaaacggatacacacttgatactgtacaggtgcttttgaccacacctgattatgactgggagagatatggcttctgggtgaatgagggcccggcagttttaaaacgaaatggcaaggtatttgttacattttcagccagtgatacgggaatacattattgcgttggacttttgactgcggatgaaagctcagaccttcttgacccgcgttcgtgggaaaaggaccgttatccggtgctttgctccgatgagacagcaggagtttacggacccggacacaattcgtttaccgtagatgaaaacggtgatgacataatggtataccatgcaagaacggagactgaaattgtgggaaatccgctgtataatccaaaccgtcatgcaatgcttatgagatttggatggaaggatggacgtcctgtgttttcgtataactgataaggcaaaagaaaggggacatcacatggaactgatatgtaagaagtgtctgcttagagaaatggcagaggccgacgcagcaatgataaaaaaatatgttgatgcgataaagggcgaggacagagtgccggaaaaagagtatgaggcaaggcttgcagtgtgcaaggcgtgtgacaggcttaatgccggaacctgtaatgcatgcggctgttatgtggagcttagggcacttacagatgtttcgcactgtcctcataaaaagtggtagtacaaataaaataataacaaaataataacaaaatgactgcggctttgattttcgcagtcattttattattattatttagtgtttttttcagtgtcaagaggggcataattgatggatacaacaatgtcctgatcatagttaccgaagctttttccgaatattgtgagtccaccgacatgggcagaatcctcctcgacagctatgcggaagcggatggtgcttgtgtagtcaagatttagctcagaggttgtgacatctgatatcttgagaccatctatgaaggtgcctttatgatttatgactaaaagcttaagaagaccgtattgattccagttttgaggccaccattcaggggtgaacattccgcgtacatctccatagtcaccgggagaggtccaggtgccgaccagagtgtcattaatgtaaaagcttatatcacttggccagttgttgtcaatgcccggagcctcagagcttatctcggctgagagtgaaagctgggttattttctgattacgtggaatgaggtttggaattacatattccacatagccctttgtgaaccacataatgtctgcattgaaacggtcaggatggtcaaagtaacgcacgtcatcgagctctcctatcacaaatgaggatgtagccatgccgcaggttggacagacgttgtgagatgagaactgccctaccttgatggaggtgttgtatacgttgcttaagtctattggcttttcgatttctactaatatacgatcctgaatcagtgaacacagcttctggttgccgtgaccggatgaatcgtttgagatggagataagtccgcattcctcaagcttttttatatgtccggttaaagctccattgctgatgtttagctcgtttgcaagctgattcatactcatctggttattctcgagcagaatttttaaaatctggatacgaatatcagagccgagagctttaaacagttcgagaccgtcgtctaatgatgtgatatgtatcatatatagattctcctaaaatattttataaaaatgttaataaattcttacgtgtaaatcatattctaattataggaataagctactatgttgtcaatatattattgcatatgattttgagttttattgaaattaactttaaatcaaattaaaaatattgtgcaatatgtatagttcatatacgtttagacacgaaaaaaacataaaaatttagacattattaaacaatgtctaaaatagtttaaaataatctaaaataaatattgacattgcaggtggtttcatgtatattatgtacataaacaaaacacattaacgacctgttttagtcaaatagcaataagcccagcatgagattagggcaggaagttaatacaacttatcaattcaatttcattttaacaggaggaaggaaaatgaaaaagaaattagttagtgcactgatgtgtgcaacaatggcagtaacaatgcttgccggctgtggaaacggcagcaaaaacggaacagaagcagcagatgggggaacagaagctactgagtctaaggtagtgacaaacacttacggagattcaaagggaacacaccttgagatgtggaccttcgttgagctccatgcacagcactacggcacaatggtagagcagtggaataaggatcatccggacaagacgatcgagattacatgtactacatatccatatggcgatatgcatacaaagcttcttacatcacttgaggccggtacaggagctcctgatatctgtgatgttgaggttggacagttccctaacgtagttgcaggtcaggacaaatggctggtaccacttgatgattatgcaaaggattacatgagcacaatggttcctgccagaatggagacatatcagggttctgatggacattactacggagcaccttatcatgtaggcgccacagttatgtactacaacgtaaaggctatgggagatgcaatgggactttcacaggctgatgtcatcgcaaagattgatggagtaaagacctgggatgattacgaggcacttggaacagagtatgttgaggcagcaggtgagaagggtacaaaatactggacatctgttgatacaggcggaacagactggttatggcttgcaatggctgagtacggagaggactggacaggaggatttgacggaaaggcaaatgtacagcttgattcagttaagaaaatgctcacaatgcagcagaaatggttaaagagtgatcttgcagaggtatcacctgacggacatgttgaccttgaggctggtttccagaacatcatggatcacaacatcgtttcattccctaaggcaatgtggtatatgagccgtttcacaaactatatgcctgatgagaagggtaactggtacatcgcaaaatgtcctacattcgaggaaggacagaagtgctcagtaggtatcggtggaacaggtacagttgttacacagcagtctaaggcaaaagagcttgcagcagaattcctttgctgggctaagatgtctgaggttggtgagcagaatatctgggatacacttggatttgatgtatgtaacacagcttgctggacaaatgatacatttgctcacaatgatgagaaccagtacaatcagttcttcatcaactatccatacgatgtgctcaattctatcggaatggacaatattggcaagatttctgtagttaaaatcagtcctacaattaatgagaatgtatgtaatacaactctcaatgaggtacttgaggatcctgattacagcgtggatgacgcattacaggagctgcaggatgcagtagatatggagcaggaagagtaattttatagctcttaaaagggggaggtactggaggtttggcctccggcctccctttattaataagaaagaggtgcgtaaattgaagattaaaaaattcttgtattcacaaaaggttgcgccgtatgtatttgttataccatttatattaagctttgcaatattctggatttaccctctctgctcatctgtatttatgagttttgagaagattacaccacttaaaacaagctttgtgggtatagaaaattataagaagctgttgtcggatacagtattccagacagcgataaaaaacagtgcaacatatatgttctggacacttgtattactgattccgttcccaatgctttttgcagtgcttatggacagtaatcttgtaaaggcaaagggtgtatggaaagcagtgctttatatgccggctcttacatctgtagttatttcaggtactctgtttcgtctgatgtttacagagtacagcacaggacagatgaacaaaattgtaatggcactcggcatggagccttttaaatggttgaaggtcggctggacaggaatggcagcacttttggttttggcctgctggagatggaccggtgtaaatatgctctatttcctttcaggactaaagtcaattgatacttcattgtatgaagcggctgagattgatggagcaaacggctggcagaaattccgctacgtgacattacctttactcagaccgacaacaatctatgttttgacaatatcaatctatgcaggacttgcgatgttccttgagtcatacatgctgtgggcgggcaacaattcgccaaagaacataggactcactattgtaggatatctgtataagcgtggtattgagaaaaacgacatgggctatgcatgtgcggttggtatggtgcttttggttatagcacttgcaattaatatagtacagcttgtatgtaacggaacatttaaacgcgaggaggactaaaaaatggcagataaaaagaaaaaagtgcgttctgtcaaagacacaccaagacataaggttggcgttgttttaggcacaggattcttcgtaatactttgtgcgataatagtatttccggtctttgcaggtcttttagcatcgtttagaccgggcaaggagcttatcagaagaggtctttcaattgatcttgatttctcaacgatgagccttgataattatacttatctgttttcaggcaatgcagacagccagaagtattttatgtggtataagaactctcttattattacaattgtatcggtggtgcttacacttctcatctgctactttgtagcttatggactgacaatgtacaattacaggcttaagaacttcctgttctttttggtaattgcaacaatgatggtaccgtttgagattcttatgcttcctctttacaaagagattattgcaatcggacttattgattcatatgttggtgttattataacgggactttgctcggcatcgaccatatttttcttcaagcagtatctgtcaggtctgcctaaggatcttttggatgcggcaagaattgacggtgccacagagtacggtattgcaacaaaaataatactcccactcacaaagccggcatttgcttctatgggtatattgtcagcgatgggtgtatggaatgcaatcctttggccattgcttgtacttaaaggtgcagagaagtttacacttcctatcggacttaacactcttctcacaccatacggaaacaactatgatgtacttattgcaggctcaatgtttggtattttaccgatatttattatctttttaattttccagaaatatatcattgatggtatgactgcaggagctgttaagggatgatttaaaataatgtataagagataaggagaaaatatggcaaaaattattgttaataatgagaataaaaagagcacaattgctccggagatttatggacatttttcagagcatctcggaagatgtatctacgagggattatttgtaggggaggattcagatataccaaacgtaaacggcatgcgtactgatgttgtagatgcgttaaaggagatgaagatacctgtgctccgctggccgggtggatgctttgcagatgagtatcactggatggatggaatcggtcctaaagaaaagagaaaaaagatgatcaacacacactggggtggtgtagttgaggacaacagcttcggaacacatgagttttttgagctttgcagacagttaggctgtaagacatatgtgaacggaaatttaggaagcggaacagtacgcgagatgagtgagtgggtagagtacatcacatttaacggagtatcacctatggctgatttgcgtaaggaaaacggacacgaagacccatggactattgactacttcggtgtgggaaatgagaactggggatgtggtggaaacatgcgtcctgagcattatgcagatgaataccgcagataccagacttatgtcagaaattatgcaggcaatcagccaatcaataaaatctgctgtggtccaaatgtggatgactatgagtggacaaagaaggtgatggctacatgcttcgatcattgtgagcctagattccatggtcagatggatggattatcacttcattattacacacttccggagacagaggatgactggaatatcaagggaagtgcgacagattttacagaggatattttttatcagactcttaagagaggatatttcatggaggagctcatcaatcgtcatggagctataatggatgagtatgatcctgataagaatataggtcttattgttgatgagtggggcatctggtcagatgtggagcctggtaccaatccgggattcttatatcagcagaacacaatgcgtgatgcgcttgttgcaggtatgacattaaacattttcaacaagcattccgaccgtgtgaagatggcatgtattgcacagcttataaatgtgcttcagtctgtaatgctcacagacggcgataagatgataaagacacctacatattatgtattccatatgatgagacatcatcagggcgcagctcttttggacagctctcttgtaggaggaactacagttggtacaggaaagaatgagcttccgaaggtttttgagtctgtatcagaggataaggatggagtgattacagtcacacttacaaacaattctcttgagtcgtcagaggatgttgatattatactcacaaatgagggtgacaaatacagtgtaagcgaggccagatacatcgaaggtgccatggatgcacacaatacctttgaagcacctgaggtagtggatgagaaggatttcacagcatatgaaaatacgcagaccggtgtgaaggtaactcttccggcatgcagtgttgttacacttagattatcgaaataatatgatatgagggtcaaaaagtattttgaccctttaatcataatattaaaacagaattgctcagattaaggaaggacagataatatgccacgaggattaaattacgacaataaaattttatctatagtaaacgttgcagtggacatgcttatacttgggattttctggtttgtcaccagcatcccgcttgttacaataggtgcgtcaactacggcagtttattatactgtaaataagtgcataagaaataaaaaaagctatgcttatgttgaatactggaaagcttttaagagcaatttcaaaaaatcaacacttgcttttattgtatggcttataccggcagcttttcttgtggcagactgcatgctcatgaaacagcagcttaaggccggaacatatctcggaatgatgtactatttctttctggtgttatcgggagctgtactggcatgggcattttatctgttttcatacatggccagatttgagtgtacggtaaaggaggctcttaaaaaatcacttttcatgatgcttgcaaatcttggctggtccattttgctggttgcagtatttttattcatactgttctggtgcagggacatgctatggctggttgtgctgtttccgggaggttttggatgtataaaaaattattgtctggagcgtgtgttcaagaaatacatgacaccggaggatatcgcaaaagagcttgaggtaaaccgtacatatgcaagctgatcttttataataaggcacacagcaaaaaagttataaaaacggctatataatatggagagagtagaatatggatttaaaggatataaaaatagaggatccgttttggggacatatgcaggagcttgtgacagatgttgtcattccatttcaggaaggtgtgcttaatgacagacagcccggagtggaaaaaagtcatgcaatagagaattttaagattgcggcaggtctttcgcagggcgagttttatggtatggtctttcaggacagtgacgtggcaaaatggcttgagggagtggcatattcactgattataaagccggatgctgcgcttgaaaagagagctgatgacattatagatattatcgccgcagcacagcagccggatggatatctgaatacatatttcacaataaaagagcctgagcacagatggcagaatctgcttgagtgtcatgaactgtactgtgcaggccatatgatggaggctgctgtcgcctattatgatgctacaggcaaggacaagctgcttaaggtaatggaaggcatggcatggcacataatagacagattcggtcctgataagctgcccggaataccgggacatcaggaagttgaaataggtctgatgcgtatgtatcatgcaacaggaaatgaggcctacaaaaagcaggcgagatattttctcgaggagagaggaaaaaatcccgctttttttgctgaggaagccgcaaagcgtgattggaagcattttggcatgattcctgaggatacaaaatataaccagagccatgcaactatctatgaacaggatgaagcggtaggacacagtgtgcgtgctgtctatatgtatacagccatggcagatctggcagcaacggagcatgatgaaaagctttttgatgcctgtgagcgcctgtggaataacatgacagaaaagaagatgtatattacaggaggtataggctcaacagtggagggagaggcctttacgaaggagtatgagctgccgaatgatatggcatacgctgagacctgtgcatcgatagggcttgttttctttgcaaagcagatgcttaaaatgagcaaaaacggcaaatacgcagatgctatggagagggaattatacaacggaattataagtgggatgcagcttgatggaaagagatttttttatgtgaatccgcttgaggtaaatcccggagtatcgggagaaatatttggatataagcatgtcattcctgaaagaccgggctggtatgcatgtgcatgctgtcctccgaatcttgtgcgtatggttacatctctgggcagatatgcgtgggatgaggatgatgatgtaatatattcacatcttttcatcggtcaggaggctcggcttaaaaaagcagatataaaggttgtcagtgaatatccgtggaagggacatgtttcatacagtattacaccgaagacaggcgatgaatttgctgttgcaatacatattccgggatatctgaagagctttgaggtgacactcaatggcatgaggttaaaagagaatggtgagacaaatgcagatgtgatctattcttatagggatggctatatctatataaaaaataaatggcatgacaacgatgttatagaaatcagcttcaatatggatatccgtgtaatatatgccaatacaaaggtaagagaggatataggctgtgcagctttgcaaagaggtccggtagtgtacgcttttgaaggagtggacaatgatgatgatgtgcagagtctgatgatagatgtgtcaaggcttaatgaagcgcgtattgaatcagaagctgagggaaagttaaagggtgcggttcttttagatattccagcagtgagacttgaaggctcagatgcgttgtattctgaggaaccaccgagacaaaagtctgtaatagcaagggctataccatattatatgtggggaaatcgcggacttaatcagatgagggtatggatgcatacgttatgaagaaaaacggacacataagataaccgtaaataaccataaaattagcacaaaaacttattttgatttttaatgattagtgttattatgtatttgaaataaaaaccacgagagaaatataaataaacacaaataaaaataaaaaataaaataaaataaaggagaagaactatgttagcagtaaaaaattacaaattctggttctgcaccggctcacaggacctgtacggagatgagtgccttgcaaatgttgcagcacattcaaaggagattgtagccaaattaaatgagtcaggaaagcttccgtttgaggtagtatggaagccaacacttatcacaaatgagctcatcagaagaaccttcaacgaggccaatacagatgatgagtgcgccggtgttatcgtatggtgccatacattctcacctgcaaagtcatggattttaggactcaaggagctcagaaagccgttacttcatttacatacacagtacaatgaggagattccatatgattcaattgatatggatttcatgaatgagaatcaggcagctcacggtgacagagagtggggacacattgtcacacgtatgggtatcgagagaaaggtcgttgtgggacactggtcagatcctgtggtacaggaaaagattgcagcatggcagcgtgtagcagtcggtgtggtagagagcagccacatccgtgtaatgcgtgtagccgacaacatgagaaatgttgcagttacagagggcgataaggtagaggctcagatcaagtttggctgggaagtagatgcttaccctgtaaatgaaatcgcagagtctgttgcagcagtttcacagtcagatacaaacgcactcgtagatgagtattatgacaaatacgatatcctgcttgagggaagagatcctgaggagttcaagaagcatgtagcggtacaggcacagattgagcttggatttgagagattccttgaggagaagaattatcaggcaatcgtaacacactttggtgatcttggagcattaaagcagcttccgggacttgctatccagcgtctcatggaaaagggctatggctttggagctgagggagactggaaggttgcagcaatggttcgtctcatgaagatcatgacagcaggaaagaaggatgccaagggtacatcaatgctcgaggactacacctacaatctcatgaagggcaaagagggaatactcgaggctcatatgcttgagatttgtccatcaatcgcagacggtcctataagcatcaagtgccagccacttacaatgggtgacagagaggatccggcaagacttgtatttacatcaaaggagggcaccggtatcgccacatcacttgttgatttgggtgaccgtttccgtctcattatcaatacagttgactgcaagaagacagagaagcctatgccaaagcttcctgtagcaacaaacttctggacaccacagcctgacctttacacaggtgcagaggcatggatacttgcaggaggagcacatcatacagcgttcacatatgaccttactgctgagcagatgggcgagtgggcagccatgatgggtattgaggctgtatttatcgacaatgatacaaccatcagaaacttcaagaaggatcttatgcttggaaatattttctacaagtagaatatagttacacttaataattgaaatcccgggttgtctgtcacactaaggtgtgtacggacaacccgggatttattcggttgtgactcatacaaaaatgcagttactttccttgtatttagggttgtttaatgttactataattttatcagaaaacaggcagaaggagtgcgtatattatggcattaaacattccggtaggaatctcgaatttcacagaaataagatcgaataattattattatgttgataaaaccaatctgatatatgagcttttacagtcacctgggacggaggttattatgattaccagaccgcgcaggtttggaaagacactggctatgagtatgcttgagagtttttttgatataagaaaagcttcaaaagtgttatttgagggtcttgatattatgtcgcatcagagtctgtgtgaagaatggatgaataaatggcctgtaatttttgtgtcattccgtcaggtagatggtctggattttgacagtgcatgtgcgatgctttcttctgttatcgcagagctttttaatgagcatttatatctgcttgatgatgagaggattactgaataccagagaaagacatttagaaatattgctgcaggagaggcaacgcagaccgagcttaagaacagcttacggcttcttacaacgctcatgaatttgtattatgacagacaggtcattttacttattgatgaatatgatgtgccgattgcaaaggcaaatgcaggcggttattacagacagatgcttgatatgatgaagggtcttatgcaggcattgaaggataattgcgccttaaaatttgctgttgtaacaggctgtcttaagattgcgaaggaaagtatttttacgggaacgaataattttgtttcggattctgttgcagactcacggcttaccgagtattttggatttgttcagagtgaggttgatgagatattaaaggatgctcatattttaaatcagtcggaaaatataagaaaatggtatgatggatatcattttggagatgtggatgtctattgtccgtgggatgtgatgaattacgtgcttgatttacagcgtaagcctgatgcaaaaccacttagctattggaaaaatactagtgataatgcaattatcagatcatttatcgattatgcgggaagcagtattactcaaaagtttgagacgcttctttccggaggatatatagtgcagcaggttgatgaaaatctgacatatgattatcttcattcatcggaagagaacctgtggagcattttgtacctgaccggatatctgacaagtgtccgggcagacgagttggaaaatccgttgcctgaaaggtttactgctctgacaataccaaacgaggaaatcagggaaatatatgagacaacggtcatcagatggtttgatgaaagtgcgccaaaatggaacagaagcgcattgtttgatgctgtctggaaaggtaatatacaggagcttcaaggcgaattaaacagactcttacgcagaactatcagctatcatgattacaaagaggatttttaccatgcatttctggcagggatttttgccggagcaggctatatggtggagtcaaataaggagtatggcgatggcagaagtgatgtggtggtgaaggaccagataaatggcagagtagcagtgtttgaagcaaaatacacaagacagcttgaaaagcttgagtgtaagtgtgatgaagctttaaatcagatagagaatcagatgtatgcaaagcagcttgaggaggattatgatgaggtgctttgctatggaatttctttctttaagaagagatgtatggtaaagaaataatttttaaaaacgaggaaaagccgctacgtgcatgcagcggcttttgtgtagctttactatatatgtaaatttatataattagggctctcttataacgcttcctgaagtatcttcacatcccacttattcatcacatcgccctctttagctgcttctccggtgatcaggtcaaccattcctgcaaggcttgcagggagagtctgcttttcatcagtgaaattcatcacaaagtaaaagcgtgtattttcgctttcgcggcatgtgatttcaagacctgtctcttcagcaatgacacctgatacagacacttcatctgtggcttcatcaagcacccttgcaagtccttctgcctcaagctgtgtggcaacatagtatacatggccttttccgtagatgttctttgtgacagcaggcattcctgcatagaaatcgctttcatatgtggcgagtacttctgcaccttccgggtgcatcaggtcgcacagcagattgcatttatattcttttccatccgaaaagcttacagtgtttgactgctccggtgcgagcgcgtcaatctcctcaacccagacacctgccatctcgcgaagcggtcccggatatccgcccagatgcacgttgtcagactggtccacaataccactcataaatgttgtgatgagagtaccgccgtttttcacaaactgctcaagcttttccttcatgccttcctttaccatgtacagaacaggtgcggcaataaccttatattttgaaaaatcaccgtcaaccggaatcatatcgactgagatatttttgttgtaaaaatactcataatagtggtgaatctggtcaacatatttaaggtcctgtgtaggtccgcttgtgtactcaagtgcccagtaattgtcccagtcaaagatgattcccacatctgatttattacgtgtgccaagtgtccttgtgccgaagctttcaagctcccctccaagctgtgcagtctccttaaatacccttgtgtcgtttgttccgacatgtgctattacagcaccgtggaatttctcgcagccacccttgcttcgtctgagctggaagaactggatagtgtctgcaccgtgggctatggtctgatagctctgtgcacgcatctgtcccggacgcttcaatgaattgtagtgctgccagttctgttggcttggagtctgctccatgagcatgaatggctcatccttaagacctcgcatcaaatcgtgagtcatcgcaaccatgctccatggtgtgtagtatgcagggtaattatcccacgaaacgatatccatctctttagcccacttgaaatagtcaagacccttgaaggtacccatcaggtttgttgtgacaagtgcatcgggaatgatagcttttactgcatcgcgctccagcttatagcagttcagcatgctgtcagagtaaaaccgcctgtagtctgttgatattccggcaaagcttgtcatgccaccccaggcctcctcgctgagctcgttaggtacgactatctcatcccagtcatagaaggtgtgtccccagaactctgtgttccaggcatcatttacggcatcaagagtcttgtacttatccttgagccatacacgaaactgcttctgacagttgtcacagtaacagtatccgccatactcgttattgatgtgccatacagaaatatttttattgtcactatagcgttttgcaagctctgtcacaagagcctttgcgtacttctgatataccagggagttcggacagaaattgtgtctggctccaaatttatgctggcgtccctcgtagtcggtgctcattgtatcaggatattttttgaccatccatgcaggcagtgccgctgtggatgttgccatgacgatgtcgtagttttcatttgagatcatatcaactatttcgtcaagctctgtgaaattatactcattctcagacggctgtattttagcccatgaaaaaacgttgattgtggcgctgttgatatgggcatccttaaagtatgccatgtcctgctcccagacctccttaggccactggtttggattgtaatctcctccaaaaaggattcttttgaattttgactgcattttttacctccgttatggtattaaccccaatattatgatattcttaaactataagtgtgtttccttatgcactaatcatataatagatttacggaaaatagtataacatcataaaccaaattatataacattatgaaactaaaccgcttttgaaaggagaaatcatgcctatttattttggaagcaatttcgcaagagaaccgtttcaattcgactctgtcggtaacgattgggagcaggaaagtgtgacgcgcccagaagggtatccgctgtaccattatttacagacaaaggagggtgtgggtgaggtgacagtatacagcagaaatcagtctgtttcagacagtgctttgtcaaacagtcatacggttgagcttcaaaaggggcaggggattcttattgctccaaatgtgccacactcctatcacaataaaaacatctcatcctgcaatagtctgccatggaaaacagagtttgccacatttacagggacaatggcggcagccttcagggaaatgtttgatgaaaaggaataccggctgattgatgagaataagggaattgaggtgtcggaagcaattaacaaggcggtagaagactttaaggaacgctccagtgatacgcagatgctctcactcgactgttatggcatcatgcttttgctctcggaccagtctaaccatacacacgacagtgatgatcaaagctatgtgcgttttataaagcctgttatagatgctatagaagaaagctacatggacgatatcagcgctaaggagcttgccgatggtgtatttgtatcgcagcaatatctatcgcgtgtttttacggagtttatgaactgctcggtgtatgagtatctgaccaactaccgcatcaataaagccaaggaattactgcttataaacagaagacgtaaggtgcaggacattgcatctgatgtgggatactcagatgccagccattttatagtcatgttcaagaaacttacagggatgacaccggcgcagtttcggaagctgcatatataagaggatgcaactgtttcttgtatttaatagggtttgatgttaagatatatttatcagaaatatggtgcgaaaatgaatagctacaattgttttataagaattaggaagtgataatatgagtgatagaaaccggatattatgtgagttcagaaataagacaaaaagcattatgggtgattcgttaaagcagatgatattatatggttcatatgcaagaggagattatggagataattcagatatggatataatggttttgacggagctgacggatgataggattatacagatagaggatgaaatatttgatgcagcttatgatattgaacttgagtatggtgtgccgataagtgtgaatattaaaaatgaaaaacactttaaaaattgggtaaacagcttgccgtattattcaaatatacaaaaggagggaattattattgcttgaggaaaattgtattagtttagcaaatatagaatggaaacgtcaatggaaactttaaatgttgccagggagtgtttagaaaacaaacattttaaagattacaggagttcgctccactattagaggtacaaaacaagttcagtccatacagaaatgcgcaaaaaaggcaatcacataaaaagttcgtgattgcctaattttttagcatttattgtttcagggttatgattgtatggaaagtaccggaatcattatcataatacatttgcaaatttccgtgatattgtttcacgacttttttaatactcttgattccgaagccatgtctgcccttatttgctttatgggatacaggaagtccatcctgatcatacacaggggtgcttcggcaggaatttatgagtatgataataataaaaggtgaattttcctttttttctacggtaagctcaataaaagaatcagggatgttatctgctgattccaatgcattatccaataagttacagaataacgatgtcaaatcgtgctggtaaatattttgaacagtatcacttctgatatcagtatgaaaaacaatgtgcttctcgttgcattgtcgctgatagcggcagagaattgcattcagcatttcattatcgcagatttttgaggtttcttttaagtcagaagattccaaaagctgttgtatataagcatttattttatcagaatcatttttttcattgagtaatttgatagactgaagatgtttttttatatcatggatcagaatactttgattttcactttgtgaaagtatcatttcatagtattgggcaaaatccgattctttctggagcaacaactgcatatcggtatattcctgtgattttttctgattatattggtagatgccgaatacaagcagattgaccatcagcagaaaaacagcacagattgttaccataaaatcaacaggtggggcaaaggctgatgtttcaccaatagcaagaaaagtaaacataataaaaatagacgaaaccggaattagcattaaaagaagtcccgagcgatcgtactgttcatgatttatattttttcctttgaacagatgaattaataaatagatgacagcaaaaaataaaatcttgctaaaaaccgtataaaaaataattccggcatctgcttctaagagaaaatgtggaaagaatcttgacataattccgaaaactgcaagttcagatattcccataatcgctgtaagtatagcggaatggaagagtgccaataacaacttgagcttaaacaacatataaagaaaaatagtgttaatcacaaaaaagctgataatattaagccctatttgtcctagcagggaaataagaaacaatatagcataaaaagcactcaatagagccagttttattttattgctataagaagaagtaaaaaggctggaggcgtattgccataatataactgcttctgtaaaaaagctaaaaaaaagtaaaatgatatgttccatctatttttacctcatactttccagatatagtagataagtatttttaaaggaactgtacttcctgcgtgtcaggtaggcggtaatctgctgattcgataaatgtatggtggaatgatcgaaatccacaatatgttcaaaattaacaataaagctcctgtgtgtttggaaaaagctgttttttgggagctgttccagccagtagtccatattatgaatggagtcaaaatcctgccgggcagtatgtacaattacttttcgtccctgtgcttctatggcaatgatttgagaagcgggaaacgaatacaccccctatttagtttcaacaggaattttggtagtaatggaattgtaatatgttaaggcatctttcatatttcggaaaaaacgctgtttgtccaaaggctttgaaagatagcggaatacatgaaaacgcattgcctcatccaaatattcggaataagaggtaacaacaaaaattatgacatttttatttgctttttttaattcatttcctacgaaaatcccattcataccgggcatctcaatatccagaaaaacaatatctttttcgtttttatcagccaataaagattcgccactggtaaaggaaactaattcgggacattttaaatggtttgattcaaagtaggattcaatatatttctgtaattgttctattatcagagtatcgtcatcacaaattaaaatacgcatttttgcacctggctttctaatgaatgtatatatacatacatcttatcatatagaatttccaaatgcaaaaaatgcgtatgaaaagacattttaattacaattttggttcattatgtgttttgttatttcgttttacaagcagttcgataaagtctccggcaagttctatgtcggattgattacataaccgtagtttatcaataatatcctgtggaatattataagcatgcatgctgccgagcagaaggtagtctggtgtaacattgagtagattacaaatccggatgaaaatatccagacttggtttttgccttccgttttcgattgatgacatatggttattggatatatttaatttttcggcaagttctgcctgttttattcgtaattcttttctgcgtattttgatgcggtttcccataccttcatattgaaattctatttattccaccttctttcagtagaattttaccaatagaactaaataaaaagaagaatgcaacaaagaactattctgttacatattgaataaagtgtaatttatatataaataattctgtatcacatattattttacgcggaaaataggaagattattccaaaattgaagagaatcattccgttcattccgtaggggtcgtttatttgattaaagtggtatatgattgtttatgtgaaaatcaatgacaatctttaggagagaggacattatgaagaaacgggtaactaaatcggttgcaaaagggattaaagcagcattagatgttgtgttacagacggaagccaacacagcttcatgtgcgattatgtatcagccaaaagcaccgaaagaattaatgaaatacaggagaaacaagtaatggaaaaatgcacagatacagtagttgattggatgatccggtgtaatgtgataaatgaagcagataaggaactatacaagtatgcattacatagcttgattctattggtatcaccacttatcctagcaggaggtattggctttggcttgggaagcgtaaaacacggagttgctcttatttttccgtttatggttctgagaaaatttagcggtggttatcatgcaaaaaaattacacacttgtattatggggtctggttttctactgtttttgtgcataatgttatcaatgcatatgcaatgcgattggaagttggcaatagctacaggtattgcatctgtgagcctgattgtatttagtccaatagacagtgaaaacagaagacttgatactgacgagaaaaggacatataaaaaaataacagtattttgtgtgatatttttcggactgttagatatagttttattcttgttaggaaagtacatctatacaatctgtttttctgttggaatattattgacagcaggtttacaagcaccttacatcgtaaagaaaatgcgtaaatcgaccaaaaatggactgtaaatgtcgtttggtgcaataggggttgaaatcatggcaaaaataaagataatgagagttgtcattggtttcacaaaaaaagaaaaaaggaaaagaggtaataatcatgttaaaaaagaaattagttcaggtaacagcagcagcaatggcagcaaccatgttattctcagtaccggcaatggcaaagaaaaatttcttttcatttaacgtaaaaacttcagttaatgacggagaagctttttcagctggtaatcctaaaaatgatgcggaaagacaagcttacgttgtaactcaggacagtaacatcataagcacagatgcgttttattatgccgtatttaactatccgaaagatacagctcggtatcagtatgcttatcatacaaaaatgagttcaagaactggcacagttcatccacagtattataaatcagttactgcagggcagacaatgtatttacaggcagatacggacaaatatatcgtttgggcagatggatactggttctcataataatggattacatgtgcagcaaaatatcatttaacaagcaatcgtacaataattatgtagcataattgcataaacaagggggaaacaaaatttttaaattggttttcccctttaattgaaaggagaagaggattagtgaaaaagaaaataagaaaaattgggatgttaagtagtatagcattgatgatatgtttgggggtgaccggatgttatccggacggaaaagtatcattggaagaaaaaaaagaaacagatagtaaccagattaatattgatgaaaatgcttcgcatattgaaggcaaattggatgagggattatttgtgaatgcccaaacagaaataaaatctgatgcggattggcatgataataatgtgattttaaaaagctgggatgtagacaaagtgagtaatgtttttggaaatggaagaaatatttctgaaaataaaaccatgcctaatatgcataatgataatttgaatgataattatatatattgggatgacggaagttcgattgttatacagaacggcaatttacaatataatacgaaaacagaattagagtactcatatttaggatatttatatggaaccatgccatatcttacagatgaaactacagaaaaatttcctgaaacagagatttcaggtattgataaagaagcggctattgaacaggtgaaaagtattctggatgaaattggtgtagaagtttctaaacccagagtgtattctctgacatatgagaagttggaagaaaatactgattattcacaaactgatccaaatggaaatgcacctcatcagtggacaaaggaagatgcggcgtatgccatagtctttaaaggcacaatagatacgctgccgataacggaagttggatatagaagtggaccggctgcaggagaaaggattgtgggaattgtgggaaaacaaggactcatagcttttcatgcacttaatatatatgaactcgaaacagaaaatgaactttcagatgaaatattgaccacacaaacagttttggaaaatatccaacaaaagttcagaaatattatgattactgataaagttgaaatcgaaaaaattaatttagagtatgttccggtattaaaaaatgttgaaaaaggggagtatgagttaaaacctatgtttgtatgtatggcaaggcaaaatattgaacattcgacagataaggaagacaatggtctgataggagacagcagtatttttccaataatttttgacgctcaaaccggaatggaaattcagataggaggtacatattgattctacaacaattgaaagcagattacaaaagaatattcagttcacctaaaatgtatttatcaatattaggagttgtgcttttgtgttatataagtacagaaaaatatatacatggcagtgtagatatatattacatattggatattttaattgggttgagcgttttcaaaaaattgataattattttttcggcgctgccttgtgtgacaggtttttatgacgattggaaacatcaatatataaaaaatatagtcattcgaacgggaagaagaaattatattatatccaaaatcgtggtgtgcgtatcaatttcttttctggtagttttcttgggaattttgattttcataggtctattaattggtatgggattcgattatagcggaataaacggaatgggtttagatgagaatatgccatatggcatttttctatatcaaaagccatttttatatgtatgttgtatcgtcagtatttatgcagcatcaatggcagtttgggtaatgagtggattaatgatttcatcatatattcctaatagttttgttgcaatatgttcaccgctcatttttagttatttattagaagagataacgggtcttttaccgccatattttaatatgtatctgttggcgaaagcaagtaatgtattggggaaaaatgcaacgtatagctatttgtatacgatattcatatttacagtacttatattaggccagggtttgattttcgcaaaacgggtaaaaaggaggttagggaatgaaatcagttaaaatttctttgattgttgcaatacaaaatattagaaaatggagaacaaattatcggatttggatattagtgatattaactatgatatttgttcaatgttatacaaaggagatttcaacaaatgcattggctatggggatgaaaagctcaccttggctatatccatttttgtatacagatcgctatatacgaatcctttttatgttgccgttgatatttatatattgtgacgctccttttatagataagaatcagatatatatattaatgagatgtaagagaaaattatggagcattggtcaaattatttatatttttatgacatcagcaatgtatttttctttaatagcagctatgacgattgtgctaaatataagaaacatagagtacatgaatgactggggaaaggtattaggtacattggctttttcaaatgttccgttggtaaaagggactgcagtaacaataagtacttatattttaacatattttacacctactcaagcgatgttcttcacttggttattatctgttttgtgcggaggaattttaggcttaattatatatgggtgcaatgttatttcaaagtcaaaaattgttggaatagtagcttcaggatttttggttatcttgagtgcggcagtttcaggaaatgaaatggcacagtggttttcgccagtctcgtggacaacattaaataaattagatgtgggaaaattgacacaatatcctacatttacttatgtgatggttgtttatatgacagcgattattattttaagtgtatggattataaaagtaatcgaaaaaaaggatgtcggagtaatgatacgggaggtataaacatggagaagctgatacagataaagaatctgacaaaatgttttggagagacgaaggtattagataagataaatgtgaatttcgatagaggacatatttacggaatcattggtagaaatggttcaggaaaatctatgttaatgaaatgtatatgtggattggttgtacctacttcaggtgaaataataatagataataaaaaattaggtacagatattgatttgccggaaaatttagcaggaattatagaagaaccgggatttttggaaaactatagtgcatataagaatttacagtttttatctatgattaaaaataaaatagggaaagaagaaattatacaaacgttaaagagcgtaagacttgatccatacagtaaattacatgttggtaaatattctatgggaatgaaacaaagactgggaatagcacaggcaattatggaaaaaccagaaattttaattttggatgaaccaatgaacggtttggataacgatggagttatggaaatgagaaaactctttattaacttacgagaagaaggaacaatgattataattgcaagccataataaagaagatatagaagtgttatgtgatgaagtttttgaaatggagaaaggtaagcttacacctgtacaacactaaactgtcaaaacaacagtggaaccattatttaagtaaatggttcaactgttgtctttgtatgtataatatcatctgcaatccgtattccatatttatcaaggtcaaccctgccgtctatgacgtcaatgccatccgctcttagacgtttagcctgttcatcggctccgccgaaggcaaatgcccctgacagctcaccctttgcatttaccactctgtagcatggaatttcatcaggattgggattcttgtgcagggcattgccgacagcccggcacatttttttgttgcctgcaagctcagcaacctgtgcatatgtggcaacacagccctttggaatcctttttacagcctcatatatgagccgggtcggattataggtgacaaggtcatagctgtctgcaatcatgttttttatagcatcatccggtatgctgccatcgagaatgatggtattccagttgtccttgttctggtgccagccggggatgaccgatgggaaggcatccctccagaagtctcgccaggcaggagataccttgacatttaagttgataaaaccattgcgttcgtaggtccacaggaaagcctttttgctgtcctttacgcggatgagctgccagtttgggtcgtggaatggtgcttcctgatatgtatttggaaaagataaaccgtagtttaatgcttcttgtcgtgttttcatagattttgcctgccttctttttaattatacaattacagtataacatagaaagaacaaatgtttaatcgcgaaatgacaatttattgacttaattcaacatataatttctctatctcaccatcttccttagaattaacaaacaccagtgtatcatcagattttatcatgagaataggagagtatccgtcgaatacatacaggctgcattttccaagggtgcgtccttcatacctgccgatatcgtagctgtcggtagaggctccgtttgtacgcaggaaactgtcatacggcagctcgtccagaagcttaagctctgtgatgtcatttacatcaatctcgcttgtatagccaccggcagaaatagtaaggttattgtttgtcagagtgattttttcctgtatattaatcaaaggaagcatgcagacaaacaccaggatgatacagccggctgttattgcacaggtgattcctgtgaaaatccacgcgccttttttagcataattaaacgtgtagttgccggactgcatgcggttttcaatgagaatatgtttgtcggcgggattatagtagtagccggttttccagtattcatcatcgtccacatctattggtgaggtgttggcagacagcagttccttctttctgtttaagcccatataaattggaacaataaatccaaaaccggctattaactgaatgaaaatatacacataataggatgatgccggaagtattccggtgatacctgtgtataatgctacataaatccatgcgacggcgtttagtccgcttaggagaagcatggcgatacttttatattttttcatagtattgttgacaataaggttgagctttgaatccatgctgtatacgtggcgctcgcttttgtttataaaagcatgaaataccagcgaaagtgtggatattaaaacagagcacaaaaacagcgaaatcataaggatattgtaatgggtgtcaccaagcataaagtatggtatatatgctgcaagctcagtaattaaaaagagtgcgtgccatttatagctgactgtcgtggcaccggcttctgctgaaacgcgggtgtcgatataaacctttttgcgttgggcttctattatccatcctttttgtattttcagagcatacattttccggtgggagccgtttggaatatgaataattccaaagatatatgcaaacatccagataatatataccagaacaaaaacggcaatgttaaaaaaaacaataaagcatatcgcaatggagataatcacattggcaatctgaaagtgtttcattttgcattttccggtggtgatgatttcggttacttcggcatcttctttgtgagatgatggaatatgtacattgagatacatgccattttcatatttataggcgtgtgtgtacgcaaattgcatacatagtatgataaaaaggtttgtaactataaagataataaacatgataatttccatagtctttctcctctgctaagcggtacatggtttcatttgtgagtacattttatcacacattgataaaaattcctcacggctcattccggtgagacaggcctcagcacttaaaagctcaagctctgattccagcttttctgtgaaatcggtatcatctgcgatggattctgacacaaaagcgccgagccgtctgtccgtacggataaatccctcatttttcaaaatctgataggctttattgaccgtcattgtgtttacaccggcatcgcttgcaagctggcgtacggttggaagcttttcgccggtctttagctcacctttgcctattccctttacaatctggtttctaagctgtacgtatatcggtgtactgcttgacatgtcaagttctattatcatgagaacctcctgtatcttactgtttatatgtgatagcctgcttgaaatgtatcaatttttatgagcaggctgtaatctgacaaaacttgtaagtgatataaatgtattatttgtattatatacagtaatacagaaaagacattctgtcaacggatgttttagcatcaactatattgacatttgaaatattacaattatgattaaagagttataaggtatcacaacgtaaaagaatacatatgaggttataaaatgagcagattaatagagcagataaaacaaaaggaagcctgtgccttcacacatggtggcaaatttcatgcagatgatgtgttctcatcagccctgcttttgtatataaaccctgagatcagcataacaaggggcaacagtgtgcctgatgattttacgggaatagtttttgatatagggcgtggtgagtttgaccatcatcaaaaggacagcagaatcagggaaaacggtgtgccgtatgcggcatttggcctgctgtgggaggctgttggagcggatattctaggtgaggagcttgcggtaaaattcgatgagtcatttgtccagcctctcgacaacaatgacaatacaggtgagaaaaacgagcttgcaacacttataggcaatttcaacccgtcatgggattatgaaggtggcagcgatgaggctttctttcaggcggtaagtgtggcaggcatgatactggaaaacaaatttgagagataccgtggcaatgagagagccgataagagagtggaggaggtgcttgcaaagcacgatccggcaagcagaatactggtgcttcctgagtttatcccgtgtcagaaggcgctgagtgagacggatatcgcgtttgttatttttccgtcaaacagaggcggcttttgtatacagccgcagaaaagagaatattcgatgaattacaaatgttcttttcctgcagagtggcttgggcttgaaggtgaggagctggtaaatgctacaggaatttccggtgcgatattctgtcataagggaggctttatcatgactgtaaaggagcaggatgaagctgtaaaggcatgcgaaaaggcgctttctcttcataaggacagctctgtgatagtatggtatggcagtaaaggagatactgcagccatggcatgtgacagtcagacagacgagctgcttataaatgttgcaaaagcacgaggaataaagggtgtgcatatctgtcatgttgatgcaatgcctgttccgcagcttgaattaacagagcttgacagtgagacagcatatgcagaggtactgatggagaagccacagtggaaggcatatgtaaaggagcaggtgaagcagattgtaaagtacagaccggaggctgtgtatgtggaaggaaacgcatttgagacatatccggttatacgtgcactcagaaagaaacacattcctgtgcttacgatgattgaaaataaagagaaaaaaataatggtaagaataccatgatttatgtgcatttttgaaaaaatttggtataatattatgattaaagggggcaaaataccttttgaccatcatatcatattatttaaaagaaatataactattctacaagtaataatacgaggatgcagcaggtatgaagacaatcataaaatacgagcttgtcataaataaggcactcagatctgcactcaactatgatacaccggatgagcagattaatgagtttatcagattttttggaaaacatatcggttctgaccgcatatatatatttgaggattgtgatgagaagcatgtcaccaacaatacatatgagtggtgtgcggatggaatagtgccggagatacatgaattgcagaatgtcgatatggacataattcccaggctggtggtatcaggcctttggcaatgagaagaatataattatcacagatatagagcagataaaggatgagcacagggaatcctataatctgttaaaggcacaaaatgtaaaaaacctggtggtatgtccaatccgctacaaggatgagataaagggcttttttggtgtggataatccaccggaaagtgatactctcggactgaccacattcctagatatgataggaaccttgcttatatcattgcttaagctgcgcaattccttcacaaagtcgaataaggaagcgaagcttagcagctattcatcgctttcaagcatctatatatccatggcagtggtaaatgtgcagacacacagataccatatagtaaagactttggatgaggttacacactttttgggcgtgaagccacagaaagagggagagtataagatagatgaggatttcccggggcacataaacagtgtgatgaatgagttctgtactaaggcacatcgcaaggaggcacttgaatttgtggatatcactacagtagaggacagacttcgtggaaaaaataccatagtacatgagcttatcgggaaggtatcgggctggtgccgtgaaaggtttattcctgtagactatgacgatgatggcaggctttggcatgtgctttactgcgtggagaatattgacgaggaaaaacggcgtgaaaacagactcatgtatctggctcagacagatttcatgacaggtatacgcaaccgcggaagcggagagaataagataacagagtatctcgtccgcaaacagtgcggtctgttatgccttttagactgtgacaagtttaagtcaataaacgatacctatggacatgtggtaggtgacaaggtgataatagcaattgctgatactctgcgcaaatcatgtcgtgatgatgatgtcgtgcttcgcctgggcggggatgagtttgcggtatttataccggggatgcttgataaagagcgggcagaagctttttttgacaggcttttttcaaacatagagcatattgatatagcagagatgaatggaaagcatatactgctcagtcttggtgcatgcttttatgacggaatggattgtatcacgtttgaccagctctacagaagggcagacaccgccatgtatgacagcaagaaaaaacagggctacagtgcgacaatttttgatgcaaagcaatgatagtccggcatattaaataaaaagaggagaatgaaaatgcagacaggaaaagcaatatccatcccatcaatcctcaaggtgggaaatggaacattaaacaaaatcggagagtatttaaagagtgaggagctgacgagcgtagtcatttttatgggaaacggtctcatagatatgtttggagatgctataatgaagtcccttgctgatgcagatatcaccgtgcttgagtacagtgagcttgatacagttgagatagacgatatcatcacccttgcctttgatataccaaacaaggcaaaggcagtcgtgtcagtgggcggcggaaaggtgatagatgcaggaaaatacgcagcttttctaagaaatctgccatttatcagtgtgccgacctcaagctcaagtgatggtttttccagcgccagtgcatcacttttggtgcacggtaagcgtacgtcggttcctgcaaagcttgcgcatggtattatagttgatacacaggtcatccgcacagctcctgagaagtttatatattcaggcatcggtgatatggtgtcaaaaattacagcgctatatgattggatttttgaggaaaagcacggtgcaggtgtggtcaatgacttcgccgtgatggtcgctaaaaaggcggtcaacagctttgtgcgtacaccttatgagagcataaaggatgagcttttcctaaaggagcttgtggattcgcttgccatgagcggcatagcaaacgagatagcgggaagcagtgcgccgaccagcggcagtgagcatctcatttcacatgcgcttgacaaaattcttgagcatccacagcttcatggcatacaggtcggcatagcaacctatatcatgagtgtggtgcagaaccacagatatgtaagggtgtgcactgtgctcaaaaggacaggctttttcgactatgcggccactcttggcatgagaaagcaggattttctggatgcgatagatatggcgccatccatgaagccgttcaggcacacatatctgcatgagaaggagtaccgcgacgcggcaaagaagcttgtgctcgaggatgatatactgaataaaatactggtatagagatatgtatgagaagactatagagccggttgcgattatgcacaccggatttggagagaaatttggcattccgaggcagagtggcctcgtacctgaggcggcagggcagataatatttgaacccgaatacagaaatcccgatgcgcttcgtggaatagaggagttcacacatttttggattatatggggcttttctgaaaacagggtggagaaattcacaccgctcgtcacaccacccaggcttggaggccgggaaaagagaggtgtttttgccacgcgttcgccgtttcgcccaaacggcatgggactatcctctgtaaggcttgataaggttgagtacaaaagcagcaagggacccataattcatgtgtcaggtgtagatatgcttgatggcacaccgatctatgatataaagccatatctggcatatgcagactcacatcctaaggcatcagatggctttgccgcagagcacagatgggatacggtgcatgttatctggcgcgatgaggcactcaaaagctgtatggatgaagatacccgcattactgtggagcatattctggcacaggatccaagagctgcatacaacaaggccagggattatatctatggcatgagatacggcagatttgatatacgctttgtggctgattcacatgccggcacgatagagatagtggatgtcgtggagtgcatagacgggtatcataaggtgaagtgattttgatttgcatatggcgccacaagagagtaaaatggtaatgcatacaaaaggacaaatgcgtcacaaatatatttgcaaatacatattaaatacatataaggaaggtacatacaatgaaaacagtaaaggactatatcagaactatcccggatttcccggagaagggcatcatgttccgcgatgtgacaagtgttatccaggatgcagatggattaaagcttgcaattgacgagatgataaagaggcttgacggacttgattttgatgtgatagcaggagcagaatcaaggggctttgtttttggcatgccgatagcatatgcgcttcataaaccgtttgttatggtgagaaaagcaggcaagctgccatgtgagactgtatcaaagacatatgacctcgagtatggcacagcaacaattgagatgcacaaggactctgtaaagcccggtcagaaggtggttctcgtggatgatcttatcgctacaggaggcacaatgcaggcagcagcagagcttgttgaggagcttggaggagaggttgtgaagatgcttttccttattgagcttgcaggtcttaacggcagaaagcttcttagcaagtatgatgtggacgcagttgtgtcatatgatggcaagtagagctgttatatctgaatgaatatattttatatgtttgtgcatactgacattaattaaatcaatgatttgatgagattaagagtaaggagagtcggtatgcagcaaaaattgggaaagtggagtctccgttttacggaggctccttttatattggaaagcagttcggttgtaggcacaaaggaggcggacggaccgcttggtggtctgtttgatattgtaggcaaagatgacaggtttgggcagaatacgtgggaaaaggcggaaagctccatgcagcgcgatgcactcacaatggcccttggaaaagcacatctggatgcatccgacatggactatgtatttgcaggagatctgctcggacagtctatggccacaacctttggtgtggaaaacttccgtattccgtggtttggagtgtatggagcatgttccacatgcggggagtcgctctcacttgccgcggcatttgtggcagcagggtatgcaaggcatgcggtggcagtgacatcgagccactttggcagtgccgagaagcagtttcgcttccctaaccagtatgccaatcaaagaccggtgtcagcgacgtggacagtgacaggaagtgcagcatttattgtgggcagtggagcaggtggtaatgagatacaggccgggtgtgacaatgaatggactgggtgtgacaatgcagatagtatatcaaagaaggtgcagattgagggaatcacaacaggagttgtggtggactatggcataaaggatgccatgaacatgggcgccgctatggctcctgcggcctgtgagctgatagtaaatcatctgagtgattttggcagaaaggcttcctattacgacaggatagtgacaggagaccttggaagcatcggacagaagatactgattgacctgtgcaggcaaaagggcgtggacataagcaaaaatcacgaggactgtggcatgaagatgtttgatgcaacgaaccagaacacaggctcaggtggttcgggctgtgcatgctcggcaactgttttgtcagcatattacctgccaaagctaagaagtggtgaattgaagcgtatactatttgtgccgacaggagcacttctttcgcctgtcagcttcaacgagggcgagtcagtaccgggaattgcacacggtgtggtgcttgaagcagtaatgtgaagttgtaatttgaagttgtaatttgaagctgatggcttcacatatataatagggtgaacgagccgtttttgagagatgggttgcacgttcaaaaatagaagaaaggcgtaaggatataatggattatgtaaaagcatttgtcgtgggcggtatcatctgcgccatcgtacagattttaatggaaaaaacaaagctcatgccgggcagaattatggtaatgcttgtgtgcacaggagcgctgcttggtgccgtcggcatatacgggccattttcaaagtgggcaggtgccggtgcaaatgtaccgcttttgggctttggcaatgtactttggaagggtgtgaaggaggctgtggacagtgagggctttataggcctgtttaagggcggctttaaagcctgtgcggtcggagtatcggcagcattaatcttttcgtatattgcagcactcatcacgaagcctaaattaaagagctgattgattttgatggtgatttcagagtaaatatgtatcggaaaagggaaactaacacagaaaccgttgagaagatacttaggctcatccagccaatattactataatatcagattaaaatgattgataaatcctgacatttctgctattctgaataatatagaaatattgcaacggaggtggacaggcatggcggtcagagagataatcttaacagcacagcacagcacagcacagcacagcacagcacagcacagcacagcacagcactctgattgcgcctttttttcgactgttcgtattcataaaaggaaacggataaaagcatcaataaatatgtacatggattagatgtacgtattgattggtgcttttttctgtctgataaggggggatcatttgatttgaatttaaagcatggtcatacatggaaattaagaaaacgtatctattttaatactatatttacaaaaacaaaggaggattcagatgagaagattaaagcataattttaagaaaggaatggcgtttgttctttctcttgctatggtggcaggactggttcctgctatgtcaggcggagcaaatacggtgcaggctgcaaccggttccggaacagaaccaagcgtgacagcatatgctacgaaggcccagttaatgaccgcatttaccccggatgctaatggtactgctacgaccaaaggaaagctggtatttggtaagaaatcagatggaacaacagcacaggaatggtacatcttaggaaaggatgagggtgtatcaggggataataccatcatctttgccgcaaaccccatagcaacagggcagaagtttaattcagacataagcaataagaatgatgaaaatctatggtcagattgtgtttatagtgaagcgactataacagaagtatacgcaaatcactacggagcaagtgaacttcgtgatacactgcagggtatggctacgaatacatcctacttcacctcagccgagcagggcttgatgaatgccaccacagtgacaacgaaggatacgaagaatagtagtgtaacctataccaccacagacaaactgtatgcgttacagggagattatgataatgaccaatacttgtgggcaggaaccgatgacagtacagtacttgccatgagtagttacttgaggaacggagagtggttctggctgcgctcgccttacggtggtagtggtgactttgcgttgtgcgcggatcggggctattatgtcatcctcggccatgtcgacatcgactccgggagccctgttcagcccgcttccaatctggatctgtcatctgttctcttcgcatctgctgcgacagcagcatcatctgatacaaaatcggaaaagataacagacagtgcggcgatgactttaagactggacggaacaggtaaggatattggtacagtaacatataacaccacaacaggtgatattaaggtggtgaagggtaccacatcacaaaccgtggcacttgtcgtacagggcaatgacggaacaaatgactggtattacagtaaacagattacaggaacagagacgataaatgcttcagatattaagtcagcactcagtttgacatcagatatagatttatcagcctgcaaaatctggctggaaactacagacagtaccagtaatctgacttatgcggtaaatgcaactgacataataagtatcacatcagtagcaattacagatattgatattccggtgtctaatactgctttggataccgaagcatcatgtacaacagaaggtgtaaaaagcaccacaccacagattacatggacaccaagtgataccacagcgggatataatacgagatacacggcaagcattacacttacagcagatacaggctacgaatttgcagataatgtgacagctaccgtatcaggaaataccgcaacgagcgttacaaagaatgcagatggaacacttacagtaaccaaagaatttacaacagacaagagaaagatagaaagtgtagctgcgccgacagtaccggaaaataatacatttacagcttactatggctatgatggatatgatacaacgcctataagcggaacgaacacggagcttggcaagacggcaacagtaacatttgaaggaacaacgtcaccaactacagaagatatggctgtgacatggaccattgagagtgacggaggagtttatgacaaaacgccggaagcagagaacacctttaggtggactatccctgaatctgcattgacgaattataatgctgctgactgtcagggctatgatataagtacaggcaatatcacaggcacgattacggttaagaataaagccgcaacccctgtcgccataacaggaacagacagcagtatagtatatacaggtgcaaccgttgatgtatcacagtattttagcatcgacaataatgcaggagctgcaacatatacacttgttactggaacgaatggcggaaccggagaaggcacgctttcagatacaacacttaccgtaacccatacaggaacctttaagattaaggtaagtactgcagcaaatggaatctttgcggcaggagagaaaacagttactcttacggtagataacggaaccatcctgtatacggcaacggattacagcacaacctatgatggacagccacacagcatcagcgtgagcgtgaccaatcctgaaggaacagatgtaacctacagcacagatggcgtaacctacggcagtgataatccttcttttagcaatgaaggtacgcataccgtatactatcggattacgaaggataactataccaccgttgaggcttcaaagacagtaaccataaataagaagcctgttaccataacagcacaggaacaggatattgtctggggtaatgatattaaccaaagtctgtataccgtatcagaggatggactcattacaggtgacagcattaaagaaataacccttacaccaagcacaacagctcgtacagagaatggaacgatctccgtaagtggtgtgaagattgaaaatgctgcaggtgcggatgtgacagccaactatgatattacaatggttaatggtaatttgaagattacccacgatgcagcccttgcccctgagcggattgaagcatcaaagacaaagaccacgtatacagcaggcgataccctgaatatggatgaccttgcagttaccgcgtactatgcagacggatatagtgaatctgtgcaggattatacaaccaatgtatccgcaatagatatgtcagcgaatggagataagatactgacagtatcatatactaagaatggcgtaacaaagacaaaggatattacaataaaggtaaatgcagctctggcatcttataaaattatatctggtgcagacagtgagtggaagcagaatacagacgaaaccatcactatcataggaaatggagaattttctaaatttgaaagcgtaaaagtagatggaagcataattgatgcaaagaactacaccgcaaaagaaggttcaacgattattatcttaaaggcagattacctgaaaacactttctgtcggaacacattcatttgaaatcgtatgggcagatggctcagcagttacaagctttaaggtaagcaagaatacatcagataatgaaggtagtaaagacaacaacggtaataagaacaacagcaatgataatccaaatagtaatctggcagctgtacctgatgacaagaaaacgaatggcagtgacagtggaaataatgcagacgacagcctacagataacagcacctcagactggcgataacagccatccaatgctctgggtgacattattagctgcttcacttgccggtctgcttgcattgttaagtgtacgcaggaaaaaagatgaggaataatatgcagcgttaagacttacggcatataatttcataaaagggataaccgggttgtgctcggttatcccttttaagatggaagcatttcagtaagtgtatcaccaaaatctacgatacggactttctttctctttgtcggtccaatctcagttttgtgtcttgctccattgtagcggatacttcgtcttacagtcagatattgttcctcaaggttaatgtcctgccatgtcagtccacatacttcgccaagtcgtaaacctgtaaaatatgcgatctggattggtatcatagcttcgattatcgtactataccgaatcgggattttttgctgataaaagattggctagtcgattctttgctgtctcaggatttttggaatacagtcttacaatatcgcccatatcattaaatgcgttgatggtgtgtgtgatttctctaaggaacatagatccaggtctttggaaaaatcactttcggactgttccatatcataagggagtttattcagaatggaagtcattgcatcacgaatctgtaattctcttttatccgtaatgtctgtttcgtattcgtcagtctcacctttcagccattccacagatacatgaagtgcatctgccagaccctctaaggtcattttcttggtgttatcaatcgttcctgcttcgtatctctgaatcgtggatgctgtcacgcccatcgtccacacaatttacgaaaagtgctgtgagaagtcctaccaatagcaccaaaattctaaagtatagtaggtggaatttaaaatttctcttaaaaaacaatctatatgattatatttatcggagaaaatgacgatacagataatatattagaaattttggggtttgatgagtatttgtaaaaccattgaaacaatttcaacaacatcaaccaaattttcttacggatattataaacaaacaattaactgtgttatcaaaacattaattgtgaatgaatggattcagacaaggaggacaaaggatatgtcaatgaatgtgaacacaactgctactacctatggaaactatcaaaacaactaccaaacaagtggaactgataagaaaaatgaaactacaaaatctactaaaactacagaaactaagaaaagttcagtagaaagtttaggtgaaaaaaatctaagccgagcagctcaaaaagttcttaaagatcttcgagggtcaagaaatgatatggatttttatgtagcagattttgagaatggtgataatgccaaagatattttatcaagaagcgataaagagtttactgtcattttttcaaaggaagaaatggaaaaaatggcatcaaactccaagtattatgccgaaaaaatgcatagcattcaaggtgctttgcgtatgtcagaagaaattaacgcacagtttggatttgaacgagcattcggaaaaacaactgaaattggaaacagcatagatagtgacatgaaaatcacaaaattcggtatttcttttaatagtgacggaagcacctcattctttgctcagttagaaaaaacttctgaaaatcagaaagattaccttgagaaaattcaagaaaagaaagctgccgaaaaaaaagaagctaagaaaaaagagcgttcaacgcaagtcaatataaaaagagctactgttgaagctaattcaaaagaagaacttttagacaagataaaaaatatcgaatgggattctatcaagccagaggataataaaattggcagtagatttgatttctcaatttagtatatttaggtggggataattatacaaaatgtgtggaggtaaattacttataagaaaacgaattttttctattgtattgtgtgttgtactgcttctttcaatgaatgttaccgcttttgctgctgagtcacaggaaaattatatagaaactgagaagtcagttacatttgaagttacaccaacagctttaacagctggttcatcaagacattcggttggaatgttaaattccttttttggaacatatgataccgtagcaacttctgctcttggttcatttactatgatgagaaaacaaagctgtggtgcaatggtccggcatatatagctgaattgtatagggaagagttaaagaaatccggatatcagatttgagatgaatgcatatccagttgctgttaaaaatttccgctattatatcgttgtgacaacttaatatttcagaagaatgatgtataaattacgaaaaattgcccatactatctccaaaacgaaaaggagactgatacaatgaaaaaaatgaaatatttattggcactttgcctgatactcgctgctgcaagcgcttttgcagcctgtggaaacaatagtaatgtggctgacacctcaatggttgaaaatacacaaagaggtggctctgccgccgacgatgccggaaatgccggcaaggatatcatagatggcgccggaaatgctggcaaggatgtgatagatggcgcaggcgatgccggaaaagatgtgatagacggagcaggcgatgccggcaaggatgtaatagacggcgcaaaggatgccgtagatgatgccggaaacgccataaaaaagagtgttgatggtggaaacaactaacagctatttataaaaagaaaacagttactatatatgcttcaatgactgcaaaaacaaaagcaccgacaacatcgctgataaaatgcacacctgatatcacacggacacaggcaatgatagctgcaaggactgcaagcaaaatgccggtgaaccataaaggcgaagcagcaggtgagcatattaaaacagtaaatgcaattataaatgcagaaaaaacatgcctgctaggaaaagaccttccgagggtatcctttggaatgacaggcggcatatcaaatttttcgtatggacgtggtctgtttatgatatatctgaaaaccgatactgcaataaagccgacaaacggagcaatgattgagagtgcaagcatatgaccggctgtaaagcacagatacagcacgtatacagggtatgtgataaaaactaaataagtgcatattttattgattaattcaagctttcgggctgccctgttattttcacggaatggggcagtcatttttatgtatgtattttttttcatgattattttccatcgtttatttatgaaatattgtattgtaactgtctagagtggtgtcaactgcccttgcgatactgcagaggtgtcatgccatagtgctttttgaaggctctgttaaaatacgacaggctttcaaaccccacttcaccggaaatagaaagcaccgagctgtctgaactttgcaaaagtcttgcggccatggtcaggcggtagtcctttaaatagtcaacaaacgatgtgcccatggtttctttaaaatacctcataaaatgagactcggaaaacccggctacatcagcgatatcagcgatagagattttgtcggcataattattttccacatatttgagcacaaccttcatcttatcaagagtctttttactttttagtggctttgtcagattacggcagcggttatcaagcacaaaaaagaattcgtagagcttgctctttatataaagctgatagccctgcggcatcgtcttgcaaatctcatcgcatgcatctattggagccacgacatcctcgtagtatggatacaccggtgtaaaaaccgtcggaactgtgaatctgccggttaagagaggtgtaagaaaatcctccttggtgtaatcgtactttccgggaagcagcatcgacagggaaaatatgatattttcgtactccatcgattcatccatatattggtctatagagtgaagctgtcccggcagaatcagcacaaggcttggcgctgtgacatggtactccttaaaatccacagatatatgaccgcagcccttctttatatagataagctccatgtcatcatgccagtgcagcggaactccggaaaaatcaaggggaatcgagcacaggtaggtattgtatgggaacgtaagctccacatgtgttttgtcttcgtgataattttcatattctaatatattcatgatgatattttagcatattatttcttgaaaagccactaaaaataccgaaaaatgataggattgtgcaagttttcgactgtatactgcaagaattgtgcagtgtaatggattatacttgattcatcaaatgacacaaggaagttaagcacgctaaatgaaaattagttaatttgacacattggcgtgtacacatgataacagatttgggaggaaatcaaaatggcaatcatgcaggaaatcgaaacaaagcttcagaagggaatcagcgttagtacagacgaggaagtatactacgcattacttgagcttgtaaaagacaaggcagagaaaaaggtttcaaacaaaggaaagaaaaagctctactacatctcagcagagttccttatcggaaagcttttatcaaacaaccttatcaacttaggcatctacgatgaagttaaagagactcttgagaagaacggaaagtcacttgctgaaatcgaggaaatcgagcttgagccttcacttggaaatggcggacttggacgtcttgcagcatgcttcatagattcaatcgcaacactcgggctcaacggagacggtgtaggcctcaactaccattatggattattcaagcaggtatttgagaacaatctccagaaggagactccaaacccatggattacaaaggagagctggcttacaaagacagatatcacatatcctgtaagctttggcggattcacagtacagtcaagactttacgatatcgacgtagttggatacaacaaccgtacaacaaagcttcacttattcgacatcgagtcagttgatgagtcaatcgtaggcgacacaattgatttcgataaggatgatatcaagaagaaccttacattattcttatatcctgatgattcagatgataagggacgtctccttcgtgtataccagcagtatttcatggtatcaaacgcagcaagacttatccttgcagaggcagaggcaaagggctctaatttacatgatcttgctgattatgcagcagttcagattaacgatacacatccatcaatggttattccagagcttatccgtctccttcaggagaagggcattctgatggatgaggctattgagattgtatcaaaggtttgtgcatacactaaccacacaatccttgcagaggctcttgaaaaatggccaatcagcttcttggagaaggcagttccacagcttatgccaatcatccgtgagcttgacaacaaggttcgcgcaaaggtagctgacgagagcacatacattatcaaggatggtcttgtacacatggcacacatggatattcatttcggatattctgtaaacggtgttgcatacctccacacagagattttaaagaatacagagctcaacaacttctacaagttatatcctgagaagttcaacaacaagacaaacggtatcacattccgtcgttggttaatgtcttgtaacccggagctttcagcatacatcacagagcttatcggtgacggctggaagaaggatgcaaacgagttagagaagcttggaaatttcatcaatgatgacgctgttctcacaaagcttgttgacatcaagaatgcaaagaagacagagcttgcttcttacttaaagaagactcagaatctcgacgtacctgacaattcaatctttgatatccaggttaagagacttcacgagtacaagagacagcagctcaacgtgctttacatcatccgtaagtactttgagatcaaggcaggcaagaagccatctacaccaatcacatgcttcttcggtgcaaaggcagctcctgcatatatcattgcaaaggatatcatccatgcaatcctctgcttacagcagattatcaacaatgatcctgaggtaagtccataccttaaggtattcatggttgaaaactacaacgtaacattagctgagaaattattcccggctgcaaatatttcagagcagatttctcttgcttctaaggaggcatcaggaacaggaaacatgaagttcatgcttaacggtgctattacacttggaacaagtgacggagcaaacgtagagatagctgagcttgtcggcgatgagaacatctatgtattcggtgaggattcacagactgtcatcgacagatatgagagaggcgactactgctctaaggattactatgacaaggatgcagacttaaagaaggctgttgacttccttgtaagtgatgagatgatgaaggttggttctaaggagaacttagagagactttacaacgagctcctcaacaaagactggttcatgacattcccagactttgaggattactgcaagacaaaagagaaggcttacgctgattatgaggataagaaggcttgggctaagaagatgcttgtcaacatcagcaaggctggtttcttctcttctgacagaacaatcaagcagtacaatgatgaaatctggcatttagaggcatagaatttttcttcctcctttaaatacaaattgggcttaagaactcctgcgggtgcatcccgcgggggttctttttttgctagaggacgggacgtaagcgcaggggacggcgtgcacacatactcttgcgttcgctacgctacgctgccaagtgtctgtacggattatgcccggaatgtttcacaggctgacgaaaccggcttttatgcgccgtccgtggcgcataacgccttgccccgccgtccatggcggtgcatttctgtggttctaagcataatcctacagacactaggcagcttcgctatgcgctctcgcaagagtatgtgtgcacgccgtcccctgcgcttacgtcccttacgctgtggcaaaatgtgtggggtgacgtgtgcgcaccggtggccggtgcttacgtcaccggccctgcctcaccgtgaactgcgggcccctagcagaaatgtaagggcgggatttacaagtttggcaaatacatatataataagaggaagaatatacacatggagaactattatgataaagaataaatttatggcactcacgcttaccgtagtgctcacagcaggcatgcttaccggctgtggctccggcgacaaggcaaaggacaaggatgcgtacagacagtatggcatcaactgtatagaaaacggcagctatgatgatgcggtcgatgcttttcagaaggcactggaccagtcggtgggctcagtaggcgcagaggagcttgacatatgttattataaggcaaaggcacagtatttaagcggtgacgtggatggagcaattgatacatatacggctattatcgactataataaggattctgacgcatactatctgagaggctgtatatattttgccaagaatgattcagacaagggcttgaaggattttaagacggcgctcagtgagaataatgataattatgagctctatcttggtgtttatgagaccttgtcaaagtatggcatgaatgaccagggaaaggaatacctggataatgccttaaagcttaaggcaaaaacggctgacgactatatgcagagaggccgtatatacaccatgctcggtgattatgattcagcaataaagagtctgaaaaaggctattgatgagaagcttgtcaaggcaaactactatatgggtgaggtatatcagaaaaagggcgacaatgacagctcgcagaagtattttaagaaatacctggacagcggtgaggcagattcgtatgagctgatgaatatgggacaggcgcagatggacaatggtaactatgacactgcgattacttattttcagaacgcacttgaacttgaaagtgtgccgaacaagcagcagataacaaaggctatgattatagcatatgagtattccggtgattttgccacagcaaagagcaaaatggaggaatacatgaaggattatcccgatgacgaggatgcagcaagagaatatcagtttttggagaccagatagattatggcagatactattaagatagaggatattgaggagagagtggtgcttgtcggagtgagcgagcaggacggtgatgatgcagatgattcactttcagagcttgcggagctggtaaagacagcaggtgcgacagttgttggcacacttatccaaagaagagaaaaaattcatccaggcacatatgtcggcaccggcaaggtggcggagattgcagagcttgtggagagtacaggggcaacaggcattgtgtgcgatgatgagctgagtccggcacagcagaagaatctggagacgtaccttgacacaaaggtcatggacaggacacttgttattcttgatatttttgcatcaagagctacaacaagtgagggtaagatacaggttgagcttgctcagctcaagtacagattaagccgtttgtcgggactgggaaagtccatgtcgaggcttggcggtggaataggaacaagaggtcccggagagaaaaagcttgaggtggaccgtcgtcttataaatgacaggatagcacagcttcgaagagagctgaaagaggtgcagaagcacagagatatcacaagggcaaagcgtgagaaaaataaagtaccggttgttgcgatagtaggatatactaacgcaggtaagtccacgctgttaaatcacctgacagaagcagatgttcttgaggaggataagctctttgcaacgcttgatcctacaacgcgcattcttgcgcttgatggcaagcagcaggtgcttttaactgatacggtcgggtttatcagaaagctgccgcatcatctgatagaggccttcaagagcacccttgaggaggcaaagtacgctgacatcattttccatgtggtggacgcatcaaatatgcagcgagaaaagcagatgttcataacctaccggacattggatgatcttggtgtaaaagacaagaaatttgtcacactttttaataagcaggatgcccgcacagacaacgaaccactgcatgatttcagggcagattatactcttaacatttcagcggcaaaggatctgggattagatgaggtaaaatctcttttagaggagatattaagagagaacaaggtatatattgagagaattatcccatatgataaggcaggcgtgatacagctcatcagaaaacagggcgagcttgtgtcggaggaatatgtggctgatgggatacagataaaggcatatgtgccgatggaggtgtacggcaggctcgattagggtgctgcttcgctatatcattataataagcgaggaatttaaaatgtcgaaaacgcgttcaatccgctgggacaagctggataacacagcaaatctgttccctagtatagcgggggagagcatgacaaatgtatataggatctcagttaccttaactgatgagattgacagtgaaaagctgcaggaggcactggatatagtgcttccgaagtttggtctgtttaatgtgagactcaggatgggagtattctggaactattttgaggaaaatggcaaaaaggcaccaaaggtgcatgaggaaaatacatttccgtgcagatttataagaccgaacaagaatcacagctatcttttcagggtgacttactataagaacagaataaatcttgaggtatttcatgtgttgacagatggcatgggcggcatcaatttccttagggagctcacctatcagtatctgcgtctcacacatccggagattgcaaagctaaagggcgattcattgacgcagggcacatccttaaatagagaggacagctttgtaaagaactacaaatcaagtaagccaagtggctttaacaggcagaaggcgtatcttttaaagctggaaaaggtacctgatggagagtttgggctgatacatggcatgatgcctgtatcacagctgaagcaggtctgccaccgctatggagtttccataaatgattatctggtagcatgctttgtgtggagtgtgtatcaggagtgttttcacggcatgccaaacgatatgcctgtcagggttgcggttcctgtgaatcttcgtccttattttgactccgtgaccacaaagaacttttttgttatgatatctgctgagttcagaccgcaaaacagctcctacacatttgaggaggtgcttagaatagtgacggattccatcaattcacagatttcgaaggagcatctggaggatcttttctcatacagtgtgtcaaatcagaaaaatatcctgatgagaccggtgcctctttttataaaaaatctggcaatgaaggcggtctatacgcagtcggcactggcaaacaccaccactatcaccaatattggaaatataaaggtggagccggaatacgagccgtatataacaggcttttattcctttataccaatgtccaagggacagcctatgaagggcaccatatgctcctacaaggacacgctggtgtttactttctcatctattctggccgatacgatgattcagagaagcttttttaagaagcttgtaaatgacggagtggaagtgacaattgagacaaatggagagtattatgactaaatgcatgaaatgcggtgtgtatattgcagacaatacagataaatgcccgctctgccagcaggttgtggcaccggttgaattgtcatcggacaatcatcagggcactgaaggggtttttgaacagcataatgatgtgccggataagtgcgtaaacgatacagatagtgcagcaaagagggcagatagtacagcaagccatgacaacggtacgagatatcctgacgttaagggcgcatcaagaaaatacagattactggaaaatatcatattgtttctgtctatagtaggacagattgtgctgacaactgttgattacatgacagacaatgagataaactggagctttatagtgcttcttgttgtaatctatgcgaatgtgacgctgcgtctggcaatagtcggaagaaacggatatatatttaaaattgtaagcacatttgtgttcacggtgctgtttctcgagggcatagacctgctcacaggagccagtggctgggcacttacatttgttttcccaagtgccatactggcgatggttcttgcaacaattatacttatgatagtaaacataagaaactggcagagctacatgatgatgcagctttttcttgtgctgatgagcgtgattgcgatgatacttgtggcagtcaaggtcatatggttcccatatctggcaatgggagcgatgggagcatcgctgtttttgtttctcggaacactgattatcggtgacaaaagagccagaacagagctgaaacggagatttcatatatgataggctttcatggaataggaaattcgcatatgtttgaggatgaggagatgggaagctaccatccggaaattgaaaacggcgatagtaatggtgataatgaaactggaataataggagctttgggtaataagcttgaaaagacatttaagaactcattatctgccatgaaaagtgagcatgtggaaaaagtccatagcaatgcagctgtggcagatgaagaagtcagtatacagggaaaaatacttgccaatctgatgggacatatcacaaatgaccttgcaatcggcaaaaaaataaaatccggagagctcaggaagcgcatgaaggaacctgcctggcttgttccggactgctttgtaacagaggatatagatatgggcggtttcactatgaagcttttatcctcaaaggaaaacccaaatacagagcgtgtgatactgcagttgcatggtggtggatatatgggggcagtgcgcaatgcatactatgtatttgcaggcctttataatgaggtaagtgaaggctgctcagtgctcacgcctgactatcgcgtggcgccggagcacccgtatccggcagcacttgaggatgccatagcctgctataaatggctcttgtcacagggctggtttggctcgcagattgtgctggcaggagactcagcgggcggaggccttgcaatgtgcctcaccatgtatcttcgtgaccacgacatgccgcttccggcaggaatagtagccatgtcaccatggacagacctcacagcaggaggagagtcatatgagacaaactacgaaaaggacccactgtttgggaacacaagggacagtctaatctacgtgaatgactatcccggtgaccacgataaaatggatccatacatatcgccgctgtttggtaatttcagaggctttccaccaatgctcatacaggtaggctcgatagagatgctcttatctgactcggtagaggccgctgcaaaggcaagaatccagggcgttaaggtgcgactgtcagtgtatgaggggatgtttcatgtgttccagatgggatatctcaatttcccggagtccaagcgtgcatgggcggaggtcaagcgtttcctaaaggtgattaaagaggaagaatagaggagaagcagataatgattaccggagaattaagaaataaaatagataaaatatgggaaacattctggacaggtggcatcacaaatccattagatgttatagaacagtttacatatttactctttataaagcagcttgacgaagttgagacaacaaaagaaaacgaggcaaattttctcggtgtagactatgagtctatgtttccgggtgaatgtcagaaataccgctggagcaaatttaaaaatctcggttcagcagaggaaatgtatgagcttgtcttaaatggtgtatttccgtttataaagaatctgcatcaggacggagattcggcatatgccagatatatgggagatgccatattcaagattcctaccgcggcaatgctgtcaaaaatagtcgatggaatagataagcttgagctgggagatgaagattctaagggagatttatacgagtatcttctctcaaaggttgcaacagccggaaccaatggacagttcagaacaccgcgacatatcataaaaatgatggtcgaactggtaaaaccgtcaccggatgatacaataattgatccggcaatgggaagtgcaggctttctgatagaagcacagagttatctaagagaaaaccatccggagcttttccttcacaaggagagccttgagcatttcaataacacgatgttttatggcaatgatatggatagaactatgcttcgaatcggagctatgaatatgctgcttcatggcgtggaaaatcctaatatttcgtacagggacagtctttcagagcagaatacggatgttgaaaaatatagcttagttctggcaaatccaccgtttaagggaagtctggactatgaggctgtttcagcagatttgcttaaagtgacaaagacgaagaaaacagagctgcttttcttagcactatttttgcgtatactaaaaaaaggtggcagggcggcagtgattgttcctgatggagtattgtttggcagcagtaaagcacataaacaaatcagaaaagaaatcattgaaaacaataagctcaacgcagtcatatcaatgccaagtggagtgtttaagccatacgcaggagtgtcaacagcaatccttattttcacaaaaacaggctcaagtgataccgacaaagtatggttttatgatatgaaggctgatggattaagtcttgatgataaacgtcaggaaatcgcagacaatgatatcccggatattattgagagattcaatcatcttgatgcagagactgacagaaaaagaacggatcagagcttctttgttcctgttgatgagattgtgtcaaatgattatgacctttcaatcaataagtacaaggaaatagtctatgaggctgtgcaatatgagccaaccgatgtgataataggaaagatagacgctctggaaagtgagatacagggtgaactggcagagcttaagaaactgttggatgtgtaaaagcaaattcgtgtttgtagggaaatgtagatggaaaaagtgaaattaacggatatatgtgattttcaaggtggttcacaaccgccaaaagaagagtggtcatttgatgagcaggagggatatattcgtatgctccaaatacgagattttactcaaggtgaaagagtgacaccagaatatataaaaataagtaatactacaaaaatgtgtgaggcaaatgatattttaattgccagatatggagcgtctattggaaagatccttacaggacttgccggagcatataatgtggcaataatgcgaacgattccggatacgagtagaataaaaaagctatatttgtattattatttgaagtcaccatattttcagaatgcaatattgaatgttggttcaagagcggcacaggctggatttaataaagaggatttatcaaaattagacattgaatgtccagagctaataaagcaagataaaattatagctgtcttagagaaacttgagtgtattatagaaaaaaggaaaatagaactttctaatttagatgacctcatcaaagcccgatttgtcgagatgtttggtgatccagtttctaatccttatggatatgataaggttgcactttctgatttggcagatattaagattggaccttttggttcgctactacataaggaagattatattgatggtggacatccgttactaaatccttcgcatattgttgacggtaaggtttctccagatgataaacttacaatttctgatgaaaaatatgaagaattatcagcatatcagttaaaaactggggatgttgtaatgggtagaagaggtgaaatgggtagatgcgcagttgttcctgaagatggattcttgtgtggaacaggaagcatgcttatcagaactaaaggggaagttactgctgattatattcaaaaaataatatcgtttccatcatttaagaaaactatagaagatatggctgtaggacaaacaatgcccaatcttaatgttccaatagtatctggttttcaaataattaagccaccgatggaagtacaagatagatattatgcgtttgcagaacaagtcaacaaatcaaaagttgcagttcagaaagcattggatgaaacacaaatattgtttgatagtttaatgcagaaatattttggataagaaacgaagtaatataggagcctttatggatgtaaatagtacctttgaaaaaacaggaataaaatgtaaagtattacaggaaattatccagctagcgaagaagaattgtgttgaaaaagtaattctttttggttcaagagctcgaggtgattttaaagagcgaagtgatatagatttggcattttgcggtggtagcagtagtcattttattttggatgtagacgaaacaacttcaacgttgttggaatttgatatagtggatttggataagcctgtaagaaaagaattgttggaatcaataaaaagagagggggtagtgctatatgaaaaaatttgaaaattttaaggcagcattagtcaatttgaacgatattttttcttataaagaaccatatggaaatgtggaaattgctggcatggtaggattatatgaaatctgttttgaacaatcatggaaggcgatgaaagaattattagagaattttggttatgcggagggtgcaacaggatcgccaagaacaattttaaaaacagcttacaaggcaggaatgattagtgatgaagaattatggctggatgcattggtttcgagaaataatgttgcacacgcatataatcaggcaattgcaatggatattatacgtcaaaccaaagaaaagtattatgatatgtttatacaattagagaaaaaaatagaacaggattggctatagtagagcatatcgcaagtaaaatttttattatggattattcacaggctgcataaatacaattgccggaataaattgcatttatgcaggagaaggatgttggtatttcgaagggagatatcaacatggaagaaaaaatagttaaggttttaaatgtaatgtcagagtatttatcaatagctcagatgaaaaaattgcaggaagttattctacaaacatttgcagaaaatgaagcagagaaagcagagattgcaaatgataaatttttggaaatgtttcttgatgcaaaaactatagaggggtgttcagaacgaacaataaagtattatagggaaacagtgcaacatctgttgttacaaactgaaacatctgtccgtaaaataacaacggaagaaatacgtgaatatttgtcagattatcaaaagctcaataattgctccaatgtaacaattgataatgttagaagaaatatctcaagcttcttttcttggctcgaggaagaggattatattcttaaaagtcctatgcgcaggattcataagattaagaccaaaacagttgtaaaaagcgtgatttctgatgaaggaatagagaagcttcgagataattgtaatgaaaagagagatttggcaattatagatcttttgtattctaccggaataagagttggtgaactggtaaacctgaatatagatgatattgatcttgaaggacgtgagtgtatcgtttatggaaaaggtgataaagagcgcagagtatattttgatgcaaaggcaaaagtacatctaaaggattatattgataccagaactgataaaaacaaagccttgtttgttacattggatgcaccacatgacagacttaagataagtggtgttgagattcgattacgaaaactcgggagaaaactgtccttagagagaatacatccacataaattcaggcgttcaatggctacgagagctattgataagggaatgccgattgaacaggttcaaaagatacttggacattcccagattgataccaccatgcagtatgctatggttaatcagaataatgtcaaaactgctcatcagaagtatcttgcttagtaaaaatgagaaaaggtcaattcgtgtttgtaaaattcttgataaatagaatgcatgttagacaaaaaggcgattagatgttaatatagtataaaagaagtgctaccgatagacggtcagcctgatatatgtattgattaaagataaccgccacagtttaccagaccagggcggttatttttgtgtcttggaaagattaatggtgtttatagcaggagtgatgtagatgagagtaaaacttgaggatgtttgtgagcgtggctcatcgaacataaaacagtctgatataattaaaatgagtggtaattattcgatttatggtgcgtcaggattggctggaaaagtaaatttttatcatcaggagcaaccatatgtagctgttgtcaaggatggagcaggaataggcagaacaacattgaatccagcaaaatcttcagtgataggaactatgcagtatctaataccaaagaaaaatgtattaccagaatatttgttttatgctgtgagttatatgcatttagaaaaatactatactggagcaaccattccacatatttattttaaagattataaaaatgaagaatttaaccttgataatatagagaaacaattggaaatcatagatgttttgggtaggtgtaaaaaggttatagaagccagaaaacaagagttagttgaattagacagcttaacgaaagcccgatttgtcgaggtctttggtgatattaatattaatgataaaaattgggagtgtgaatttttaggaaatctttgcactattgttagaggaggatcaccaagacctatagaaaaattcttaggtggtgatgttccgtggataaaaatcggagatgctacggaagctgacaatatatatttgagttcgacaaaggaacacatcattaaagaaggggtaaagaatagtagacttgtaaaagaaggtagtttaatatttgcaaactgtggagtttcattaggttttgcgagaattatcacttttgatggatgcattcacgatggatggcttgcaatggaagatatagacaaaagacttgataaagtatttttgttacaagcattaaatcagatgacagaacatttcagggcaattgctccggctggaacacaaccaaatttaaacactgcaattatgaaagcgtacaagcaggtcattccgccgattgaattacaaaaagaatttattagatttgtccaccaagtcaacaaatcaaaatttgatactatgaccttcgccccaatatatgctataataaacctatatttacacacttatttttatcagggaaggagatgagcatgcatgactgaatcacttaaactaccggtgggaatagagaactttgaggaaatccgttcagacggatattactatgtcgataagacaaagctgattgaacagttagttgacagccggggaaaagtcaacctttttaccagaccgcgtcgttttggcaagactctcaacatgagtatgctcaaatctttctttgaaattggagcagcttctgaattatttgatggtctttatatatcgcacaacaaaaaactgtgtgatgataatatgggcaagtatcctgtgatatttctatctttaaagaatgtggaaggactcgattttcaagcagcaaagtatcagatgatagagataattgcaaaggaagctaagagatttgcatatttgaagcagagtgacaggctggacattgacgataagtcggcgtatgcttctttaatccgattagaggatggcagatatgaaatgagagatgaggcattgtatgcttcgcttcaaactttatctgagctgttatataagcaccattgcagaaaaacggttattttaatagatgaatatgatgttccactggataaggcatttcagaatggctattataaagagatggtttctttgatacgtgccatattcggaaaagcattaaagacaaatgaggcattggattttgctgtcttaacaggttgtcttcgtgtttcaaaagaaagtatttttacaggattaaataatttcaagattttatctattacggatacaagatttgatgaacactttggctttacggatgaggaagtagagcgtttgctggcattttatcatgtggaaaacaggtttgcggagacaaaggaatggtatgatggttatcatttcggaaatgtcgatgtatactgtccgtgggatgtaatcaatcatgttgaccgaataaaagatgatccaatggcaggaccggaagcgtattggattaatacaagcggaaatgagcttgttaagaggtttatagataaggctggtaagacaaccagagatgaaattgagcgtttaatcgcgggagaagctatagacaagcaaatccgtctggatatgacctatgacgaaatagacaataatattgataatctatggagtgttctgtttacaacaggttatctgacatatacaaagatcagtgaggacaaaaaatatagccttgtaattccgaacaaggagattaaagaagtatttaagctgcagatacaggagtggttcaggaataaaatattttccaataccgagcagttgcaggacttttggaaggctttcaaagatggaaatacacagataatggaaatgtatttaaacaaggtgctgagcaattcggtgagcgtttttgacacaaaagcgagaaatgaggaaaaggaaagctcctatcataatctgcttattggcattttgagtggcaatgaggactggctggtaaagtcaaatgttgaggcaggagagggctttgcagatattattgtggagacagatgatccggatgaaggaattattgcagagcttaaatacacaaaagattttaaagctatggaaaaatcctgtgaaaaagctctgaaacagataaaggatagaagatatcaggaatatctgttaaataatgacagacagaatatcatgtattatggaattgcattttgcaggaagagatgcaaagtgcttgtagaaagataaaaggggtgattacatggaaactaattttgattaccttttaaagaaagaagaatacgcagattttgcaaagcaggcagttgaagcagaaaaaagtttatccatttcaccggccacttgtgccattttgtcgaggcgtgcacttgagcttgcagtgaggtttgttttctcatatgacgcggagctttcgcttccgtacagagataatgtatcgagtcttattcatgagccaacgtttagaaggataattgagccaaggctgtttccaatgctcaaatataccattcatctgggaaatgttgcagttcataccaacaacaatataggcagggatgaagcaataatagcgcttcgtgatttgtttgagttttgcgattggattgattattcatattcgagggaatacgatgagaagacatatgatgagtcgattcttgcaagcggtaatgaaaagcgtataaaggctgatgagctcatgaagctgtatgagggcttaagcagtaaggataaaaagctcgagagcgtattgaaggagaatgaagagctccgcgagcagatgacaaagaagcgtagtcagaatgtaaagacaagggagttccatgtagatacgataagtgaggcagaaacccgcaagagatatatagatgttgccttaaaggaggcaggatgggttattggcagaaatgtcacggaggaggagccggttacaggaatgccaaacagcacaggaacagggtatgtggattatgttctttggggaaaggataatctgccacttgctgtagtggaggctaaaaaggcttctgtggatgctatggtaggaagccagcaggcgaagctgtatgctgactgtttgcagaataaatacaatagacgccctcttattttcataacaaatggatttgaatttttctatacgaatgattatatgggatatccaaggcgtgaggtttcaggctttttcacacaggaagagctgcagcttgagatggatggacgcacttcaaggattccgcttgaaaatatacggataagcgatgatattaccaacagaccgtatcagaaagaggctgtaaccgcagtctgcgatgctatcacaaataagcaccgtaagatgcttatagtgcaggccacaggttcaggaaagacaagagtgagcattagtattgttgatgtattaaggcgccacaattacgtgaaaaatattctgttcctcgcagacagaaaagctcttgtgaagcaggccaaaaacaattatacgaatctgcttcctgatttatcatgctgtaatctgcttgacaataaagatgaccctgagtcgtgcaggatgattttttctacatatccgacgatgatgaatgccatagatgagaggaaaaacaaatatggtgagaagctctttagtccggggcattttcagctcataatctgcgatgaagtacaccgcagcatttacaaaaaatatcaggaaatatttgagtattttgatgcgatgttacttggtatgactgccactccaaagaatgaaatcgacaaaaacacatatggagtctttgaccttgaaagaggagttccgacatttgcgtatgagcttgaaaaagcggtggaagagggctatctggtcaattattctacactggaatataagtcaaaaataatggaaagcggtattcactatgatgagctgtcagatgaggaaaaagaagagtatgaggatacattttctgatgatgacactgtaggtgatgatatatcaggagaggccgtaaatacatggctttttaacgcggatacaattgataaggttttaagagagcttatggaaaagggcttaaaaattgagggtggagacaagcttggcaagacaataatttttgccaaaaactctttgcatgcgcaggcaatagtcgagcgtttcaataagctttttccggaatatggaggagacttcataaagcggatagattatagtataaagtacagtgattcattgatagatgagtttagcacaagtgataaaatgccacagatagcagtatctgttgatatgctcgacacaggaatagatattccggagattttgaatcttgtattttttaagaaggtaaaaagctatgccaagttctggcagatgattggaaggggaaccaggctttgctctaatctgcttggagagggtatggacaaagaaagatttcttatatttgatttctgtaacaattttgaatatttccgcgtgaacaaaaatggagcggagaatggcataacagaatcactcaatgagaaaatatataacacaaaagcccagattgtcagagagcttcaggcaccggtatacagtagtgatgaggtatacgcagattacagaaaaagccttgtggatgatttaaaggaagatgtaattagcttaaatgacgatagctttatggtgaaaagacatctgcgttatgtagagtttttcagggcttcatcatcgtgggataatctggagacaatagagatttcggatatcagggagcatattgcacctcttatcaggcctaaaaaggaagatgagctggcgcgaagatttgactatctggtatacagtatagatcttggactgttgcaaagcaaaagcatacaaagtccggtgaatatagtggttcagaccgcagaaaagctgtctgccaaatactcaatcccacaggtggaaaagaaaaaggagattatcgaaaaggtccagacaaatgaattttgggataaagtcactataatagagcttgatacagtaagagaagctttaagaggtctgttgcagtaccttgacagacaggtacggccaatatactatacaaatttcacggactctataacagatggtacaccgggtgaacctttatatggcggaaatgacttgaaaaattatcgtaaaaaagtcgaattttacctgaaagagcatagtgacaaattgtcagtgtataagctgaaaaacaacaaaaagctgacagaaacggatctaagggaattggaacgaattctgtggactgagcttggttcaaaggaagattatataaaggaatacggagagacaccgataggcagattagtacgaaaaatagtcggtgtagatagagcggcagtaaacgaagccttcagttgttttatgtcagaagagcgcttgaacataaatcagatgagattcgtaaatctgatagtggactatatagtagcaaatggaaatatcgaagataataaagtattgatgggtgaaccatttaaatcagttggaagtatcacaactcttttcaaagatgatatgagtaccgcaaaacagataatggagatagtgaatcagataaagcgtaactccgaagaaattgcctgatgtatagcgaagctgtttagatactgtagatttatgcacatgaaacacagaaaatggaagaggatgtgaaaaaactcaatcgagttttttcacatcccctttttttgagcttatatattagcatctcctgcagacaggttgtggaagcataataaatttgcaaaaattataattaattctataaagtacttgacatagttactaaaagttactataataagtacataaagtgaatataagaggcgcagaaagtaattataggagttgaacacatgaataaagtagatgtaaatggattaacagaacgggagtttttagcagaatataagccgggcgattatgacagaccatcggttacagttgacatgatggtgcttcgtatgaaggaagatttaagctgtatgcaggtgcttctgataaagagaaaggctcatccggagatagacaaatgggcgcttccaggcggatttattaacataaaggaatcagcatatgaagcagcgtgcagggagcttaaagaggaaacaggtcttacagacatttatcttgagcagctctataccatgagccggccggacagagacccgcgtatgagaattattgatattgcatatattgcactgcttccatatggatatgagcagtctgccgttgcaggtgatgacgcaaaggatgccagatggttcgatgtgaaatttgcagatgaaaaacttgagtttgcaaacgacttgattaaaattgaatactccctcaagtctgagaaatttaaaaatggtgtaatcacagtggaaaactttgttccggtcagcgtatcagacgaaaagcttgcttttgaccatgaccagattatactggaaggacttatgaggataaggaataaggctgagtatacaggcattatgtttaaccttgtgccgcgtgagtttaccattccggacctgcttaaggtgtttgaggttctttcaggaaaggaagttcatccaaaggtgttccgtgagaagattgcaggacagcttgtttcacttgacaggtcgcagagacctattgtcggaagaaaaccggctgctgtgtacagatatgttgaccttaacatggatgaacgtaaactggttaaagtgcagaagaaatataaaaacggtgtgatgctcacaagggcacagccattccataacggacacctgaacatgataaaacaggccgcatcggagtgcgaaaatctgcttgttgtgataggcagtgcaaacaaaagctatacaaagagaaatccgtttccaatcgaatacagaaaaaggcttgttgaaaacgtactgcaggaagaggatttaagcggtgcagatgtaaaggttatgaccttatcagactggagcatggaggatgcagcccagtatgtaaaggaatggggttctttcttctattacaacatagctaatgaaattggagagaaaagctttacattctattataacgacgacccgaaaattgtggaaaactggtttacagatgatattttaaagaatgtgaccatcagaaaccttggcagaagcgatattgagatttcaagtacaatgatcagagatttgctgtataagaaagattatgacaaagtcagggatctggttccgcgatggatgtggaaggatttaaagcagcttggaaaaattcttatggatgcaacaaatgatgattatatgatgtaggaggaaatgattatggcaaagaaaattttagtagtagtggatgcacagaatgactttattacaggagttcttggaaacaaggaatgtgacgtggcaaccaatgttattgcagatgaaatcaggtcaggaaaatatgatgacgtgatattcacaagggatacgcatgatgaaaactatctgaatactcaggaaggaaagaaacttccggtaacgcactgtattaaagggacaaacggatgggaagtagacgctcgtcttaaagatgcaatgaaggagcgtggagttaactgtgacgatattacttatattgacaagccgacttttggcagcaaagagcttggagagatgcttgcgagatatgataacagcgatacagagatttatttctgcggattctgcacaggaatatgcgtaataagcaacgtagcgattgcaaagacgttctgtaaagacgcagaggtgtcagtgatagaaaatgcctgcgcctgcgtaacgcctgaaagtcataagacagcaatagaagcaatgaagatgattcaggtcaatatcatatagaaagccatttatcaaaaaggtttctgacatactaataacgtaagaaatgggaggagaatatcatgaaattaaaccagataatcacaagtcttttagagactgatatgtataaattcagcatgggtcagacaatattccatcagtttacagattacaagactacatggacattcaaatgcagaaatacggatgtgcattttacaccagagatggtgcaggagataacagaacagattaaggcattctgtaagcttcggtttacagaggatgagcttgcatatcttgacgacatcaaatggatcaaaggctcttatgttgattttcttcgtctctggcagccgcgttttgaggattttgagataggaacagatgcaccttgtggcttgtctatcgaggcaaaaggaacatggcttaacacttcaatgtatgagattccgacacttgccattgtaaatgaagtatatttcagaatggcatatgactatgataagctgcttgacagctttaagaagcgtctggatgcaaagtatgagaatttaaagaacggacactggtacgcgggtacattctcagagtttggtctcagaagaagactttctgctgaagcgcaggagcttgcggtgcagaagttcgcacatttgaatgatactctgcacagttcgtcaaagttcgtcggcacatcaaatgtgtatcttgcaaagaagtatgggcttacacctgtaggcaccatggctcatgagtggattatgtgtacaggacagggcaatcacaaacacaatccggcatattcaaactggtatgctcttgatgcatggattaaggagtatggagtattaaacggtattgcgcttactgacacaatcacaacagactgtttcctgcgtgacttccagcttacctatgcgacacttttctcaggagtgcgtcatgacagcggagacccgtatgagtggggtgaaaagatgattgctcattacaggagccttggaattaaccctaagacaaagacacttttattcagcgacagtcttgactttgagcgtgctgacaaactctacagacatttctgcaaggaaacaaatgtagctttcggtatcggtacatacttaagtaatgatacagatgttcctgcactcaatattgtcatgaaaaccacaatatgcaatggtatggatgtagcgaagatttctgatacacccggcaaggggatgtgcaaaaatccggattatgttgattacttaaaccgctgcattgattacaggatgaaaaatgaccgctaaaaaggtatcagaagatgacgtgataaaagtagttttaaatggagaaagccgggataataaatttattagtggtaaaatcataatttaaaaggagtgacattatgaagttggaaagtatctatgatagaggtattaagtttcatcattattgtaatactgcataccctttaagaccgaattcattggctcagtatgaagtccatgataatactgcaatcagagaagtgattaagaagaatattgaagaacaagatgagctttgtttgtatgttcatgtgccattttgtcagtcaagatgcaaattctgtgagtatgtagtactcgataagcctgaagagggagatgcagataattatgtagagcaccttttgaaggaaattgaactttatagagatattataaaaaataaaaagatagttggatatgatctgggtggtggtacaccttcgtatttgtcgattgaaaatcttacaaagattacagaatcaattaagaagtttaatcttgaagagaatatgtatctaagtgtagaaacaacaccggtaatcgcagcaaatgatattgaaaagataaaggctcttaaagaacttggatataatagaatttctatgggattccagactgtatctgaaaaattacttgagtcacttggcagagaaggatctaagtctatatatgaaaaggccgtggaaaatattagagctgtgggatttgacagacttaatattgatcttatgtatggtttcttaaatcagtcagatgaagattttgcaaatacaataaagtatacaattgcacttaatccggagtttattacattgtaccgtaatagatataagggaaccaagcttgagtcagagtcacaaggtgttaccttatataaggttaacagacaatatgatattgcttataacctattgaagaaagccggatatatcgctaataatggcaaaaatacattcagtaagataccaaaggatatgggaacttcatcatatcttacaaaacgtgtaattaatgctacatcttatattggatttggtcttggtgctcagtcgttctgtggtaattatctggcgtataatcttggttgtgcagaccatatgttgaataaatatttcgatgcgattgataatgggatttttccaatcaatgacatagcggatttaccaattgaagaagtacatgccaaggcattgtcagttatgttctattttggatttatttcaatgaaggcatttaaaaaaagattcaatgaggattttaaagatgtctatggggctcaaatcgaattcttacagaaccaccggttaatggaatatgttgatgaggatacatttatgcttactgattatggtgcagcacacttgtatggaattattccgttgttctacagtgaacgcagtatcaatgaaatgtttgctatgtcagaaagatggttgaatgataaaaaaggagaagaaatattccttgagaaatatgatagaaaggcatatgatgctccgtcaatcgcagttgatttgattgtattgaataaagacaagtcaaaggttttgttgattacaagggggtcacatccatatgttaattatcttgcacttcctggaggtttttatcagaacactgacgatacgatagaatatgctgcagcacgcgaattgcttgaagaaacatcaatatccgttaatattacagaggagaaccttgtaaagatttcatcctctaaggcaagagatcccagagggtgggtggtgagcattgcttatatggttatattgaatgatacagatattaagcctttggcaaatacagatgcaattagtgctgattggtatgatattaagtcattggagaaggaaaagctggcatttgaccattatgacattattaagtatgcactaaagtaaacaaaattgcatattcaacaatgcaaagagcattataacttcaagtttttgtgtatgtgtaattggagaggcacatttagataagaaatacaaaagctaataatagaaaaaattctaaaattttgtcagaaagtaggattgatatgcccccttattgtaaacatataaaaggaaaacattatggaacagaaatagatgattgggtagatggttattttaaataccttaaatcaacagaaccttggaactatgattttgaaaacggaaaagagaagtatttagaaaatacagattatgaacaatcaatactttcgcaattgatttttattgaaatattcaaaagtcaaaagttatccgctgatatatgtgaatgtggtttatctattacagtgaataaaggcacggttaagaaaacgtttttatttgatgtaatgcataatcccaaaagaggatgccaaccttgccaacaggctatattaaacaactataatggcggaaagatgcaatttgaaaatatatatcattgtgtagggaattttgccccaattccaagaacgataatttcaaaaaattatggaccgcggctccaacaaattcatgagtatttgaatgaattgtggccatgtttgttaaaattcatgcaagacaactggatgtgttttccaacagatatatatgaattaatgagttttaaagaatatatgaaatattcgtgccaacaaatgtattatgaaagaatttttaataaattgtattgtatctataatgcaagcgaaaacaaaacagacaatatatgggataaaattataagagaattatcaaatatagtaattgatgaacaggatcggctgatatcgtttgacaatttattaaaaaagagtgatattaaaatgattgaagaaattgataaaagaattacttttttaatagaattaagaggaagatttattatatatttactaaaaaaacaccactttacaactttatagatgactcatattttgcgaaaatgcttgttttaaggcatttataacagatgttgattttatttggttttcgactttctgcacgaaagtggaaaaaaatacctggctgcgaattccttcgcttaaggcgaatctgaaatcctgaacacttttattcatgtagccggcaaatttgtcatcgacataaggcaaaagcttcattgagtgtgtgaaactttttgaaaaaacatattatattcggtgaataatggatatatatttcttcaaagtattcctacttatattatatctcctcatcaaatccacctgtttaatagacatatcagacaaatactttaaaatctcctctctgagagcattatacatcagaaagccctgtactatatttttttataaaaaaaattgtaaactgcttgtagaaagataaaaaggatgattattttgttctgcagcagagtaagagcctacacaaatgaaaatccagtcacagcgtaagaaaaccgggagaccgtgaacgcagcagggggatggcacaccctcatgtaagcgactagcgaagctgtttagatactgtagaattatgcacatgaaacacagaaatgcccagccatggatggctgggcaaggtgttatgcgccatggacggcgcataaaagccggtttcgtcaagtatagaaacactataagcataattcgtacagaatcttaacagcaaagcgttagcgcacgtgagggtgtgccatccccctgctgcgttcacggtctcccggttttcgtagttagtcaagtgaattaagcagtctttccggtataaagctgataatactttcccttctttgaaatcagctcatcatgacttcccctttcaataatgcgtccctgctccaaaaccataatgcagtcgctgtttctgacagtagaaagcctgtgtgcgataacaaatgtagtacggccatgcatgagcttatccatgccgtcctgaacaatacgctcagtacgtgtatcaattgagcttgtagcctcatcgaggatgagcacaggaggatcggcgatagcggcacgcgcaatggctagaagctggcgctggccctggcttaggtttgcaccgtcacctgtcagtacagtattgtagccgtcaggaagctggcggataaacgtatcggcgtttgccaggcgggcagctgcgtatacttcatcatctgtggcatcaagcttgccgtagcggatgttttccatgacagtagctgtgaaaagatgggtatcctgcaaaacaatgccaagagagtggcgcagatcagcctttttaatcttgtttatattgatgccgtcatatcttatcttgccgtctgctatatcgtagaagcggttgataaggttagtgatggtagtctttccagctccggtggtgccaacaaaggcaatcttctgaccgggtgttgcaaaaagatccacatcgtgcagtacaattttctcaggcacatatccgaaatccacatcgtcaaataccacatcgccctcgagttttttgtagtccacagagccgtcagcctgatgagtatgcttccatgcccataagccggtgtgctcaggtgtttcagtgagttttccgttttcttccttagcatttaccagtgtgacatagccctcgtcagtctcaggcgcttcatcgagcagtgagaagatacggtcgcatccggcaagtgccatgatgatactgttgaactgctggctgacctgcgagataggcatgttaaagctcttgttaaaggtcagaaagctcgcaagcttaccaagggtcagaccgccaaagcctgaaagagccataacaccgccggcaagagcgcagagcacgtagcttagatttccaatctgtgcgtttacaggaccgagcatgttggagtacatgttggcattgtaggcgctttcaaagagttcatcgtttattttgtcgaaggcttcaatattttcctgctcgtgggtaaataccttgactaccttctggccgttgagcatttcctcaatgaagccgttaaccttgccgaggtcgcgctgctgtgcaaggaaatagcggctggagaagcctgcaaatttctttgtcacgactgttgttacaattaccatcacgatagttagcacggtgagcggaatatttaatatgaccattgaaacaaaaacgctcacaacagtgatagcactgttaagtatctgcggaagactctggctgatgagctggcggagtgtatcgatatcgtttgtataaattgacatgatatcgccgtgcgcatgtgagtcaaagtatcggattggcagatcctgcatatgggaaaagagctcaacacgcaggttcttaatggtgccctgtgatacgtagatcattattttgctgtatgcaaacgtactgatgacgccgatgccgtagaatacggcgacccttcccattgctgcaaggagtggtccgtagtcgggacttcctgtcttaagcagtggtactatatagtcatcaatcaaatttttggtaaacatggttccctgcacatttgcaagtacactgacaaagatacatatcacaacaattatgcaggccggtaaatatttcttgaaaataaatcccatgaggcgcgcaaaaagcttaccgggatttttaattttgggttttggacctcgtggtccccttggtcctggcatcaggcagcacctccttcatcaaagtctcctccgccgtttgtctgggaatcgtaaacatcgcggtagatttcattatttttaagcagattttcgtgagtgtcaaagccgtccacttttccgtcattcatcacgatgatacggtcagcatccatgactgatgagatacgctgtgcgatgatgagcttagtggttccaggtattgtttttgcgagggcagcacggatttttgaatctgttgctgtatctacagccgaggtgctgtcatcgagtatgagtatccttggctttttaagcagagcccttgcgatacacagacgctgcttctggccaccggatacgttggttccgccctgctctatgtaggtgttgtacttgtcagggaaggactcgataaagtcatcggcgcatgccattttgcaggcctcaatacactcatctgtggtagcatttttgtcaccccagcgcagattttcgagtatggtgcccgagaaaagcacgttttgctggagcacgacagctaccttgtttctgagagtgtccatgtcgtactcacgcacatcgtggcctccgacgattacagagccggtgtctgtgtcgtagagacggcttatcaggtttacaagggaagatttcgagcttccggttcctcctatgatgccgatggtctcaccggattttatgtctagatttatatctgacagaactggagtttcagcggtgtctgaatatctgaaggttacatgcttaaaacttatgcttccgtcaggcacatcgtaaagcggttcctttggattgtgcagtgtgctctgctcatttaatacctcgctgattcgtcttgcagatgcgagtgagagtgaaatcattacaaacaccatggagagcatcatgaggttcatcagaatattcatgcaataggtgagaagagccatcagatcacctgtagtgagagtgctgcttaccaccatatgagctccgagccagcttattaacaggatgcaggcatacactgtaaactgcatgagaggagagttgtataccacaaggctttctgccttcacaaacacgtcgtagatattctgtgctgcctttgaaaaacgtttcttctcataatcctcacggacgtatgcctttacaacgcggatagcggatacgttttcctgtacgctttcgttcaggtcatcatagcgcttgaaggctctgtcgaagtatttcatggccgccttgctgatgaaaagcagtaaagctccaagcacaatgacagcgattaaatatattgtcgcaaggcgagggctgatgaaaaatgacatagccatcgcacatattatggatgcaggggctctcatagccatgcgaagcagcatcatgtatgcattctggatgttggtcacatcggttgtcatacgtgtgacaagactcgcggatgagaatctgtcgatatttgcaaaggaaaaggtctggatgttgcgaaacattgcagcacgcagattctttccaaagcccatggcggcctttgcaccatattttgcaccgagacatcctgtcaaaagaccaaacagtgctgcgacaatcatccacacacccatgatatagatatgccttgtgtcgcccatattgacaccgttgtcgatgattgatgccatgagaagagggattatggtatccacagccacctcaagcagcatgaaaacaggtgtcgcaatcgaagcccatttgtattcctttatttgggcacctagtgtttttaacatatgttttgtcctttcttcttatatttatatttgattaaaacaaacttcccatatttatggtaatgtggttaactaaaaaaatacttgcatttaattagttagtgtgctaactatattatagatatactttttttattgtcaagaaaaatctatgaaaggatttcagatatgaaggagtttacaccggataaatacttaggacacaagataaaccgcatcagcaggagtatagacaaatattttgacagaaaaaggtgcagtaaaacagaatgtataccgcgaagccagggtatgatgattggatatataatggataatcagggccaaaatatatttcaaaaggatatcgaagcaaagtttcatctgtcaggagccacagtgacaaatatgcttaaaagtcttgaaaaaaacggctatattgtgcgcacacctatggaaaatgatgcaaggcttaagaggattgagctgacgcaaaaagcactggaccacgaaaacagggtgagggaaaatataatggtaatagaggaagccatgcacgaaggcttttctaaggaggagtttaacatgatgcttggctttttggacagagtgattgacaatatggaaaagcttaacaagtaacaaaataattacagagttgaaaaagtagcataaatattgtggctttttttgtgcaataagccaaaatgctacaaaatattgttgagcgtattgacatagcaacaatatcttgtataatttagattgtcatcaaaagacagatgcacagatttgtattaaataatatggcattttatatgtagctatatcgtaattgtttggtgaaaagcccgctttacattgcagggcagtgacatgaattaatgattacatctcatttatagctgcatattttgtgccattacacatgataaaatgtatatatatagtatgtgcattgaatgacaatactatatatagtacactacattatatggaatatagtatacagagaggagaaatttacatgaaaatcatcaagcgaagcggcagtgaggatatatttgatgcagccaaaattgtagctgccattagaaaggcaaacgattcagtgctagactatgagaagcttactgctgatcagattgaggaaattgcaagcaacgtggagactgcatgtgagaacatgaagcgctctccaagcgttgaggagatacaggatatggtggagaaccagctcatgaacaagcgtgcctttaccgtagccagaaactacattacttacagatataagagagccatcgtccgtaagtcaaactctacggaccagcagattcttagccttcttgagtgcaataacgaggaggtaaagcaggaaaactccaacaagaatcctactgtaaacagcgtgcagcgtgactacatggcaggtgaggtgagcaaggatatcacacgccgtttcctgcttcctgaggatatagtggaggctcatgagaaggggcttatccatttccacgatgcagattattttgcacagcatatgcacaactgctgtcttgtaaaccttgaggacatgcttcagaacggcacagtaatcagtgagactatgattgacacaccaaagagcttttcaacagcctgcaacattgctacacaggctatcgcacagattgccagctcacagtatggtggacagagtatctcgcttgcacatctggcaccatttgtacaggtcagtcgtgagaagttcagaaagcaggtgcaaaaggaattcgagagcgtaggccttgatttagatgaagaaaaaatcaacgaggtagcagagctccgtgtcaaggaggaaatcaaccgtggtgtgcagatgattcagtatcaggtcatcacactcatgactacaaacggacaggcaccgtttatcacagtattcatgtacctgaatgaggtatccgatccgcagacaaaggcagatcttgccgcaatcattgaggagatgctgcaccagagaataaagggtgtaaagaacgaaaagggtgtatatatcacaccggcattccctaagctcatatatgtgcttgaggatgataatatcacagaggattcaaagtactggaatctcacagtgctcgcggcacagtgctctgcaaagagaatggtgcctgactatatttcagagaaggtcatgaaggagcttaaggacggagatgtgtatacatgcatgggctgccgttcattcctcacagtggacagatgctcacagacagcgggcaatgtggcacatgccgagaactttgatccaaacaagcgtaaatactatggacgtttcaaccagggtgttgtcaccttaaatctcgttgatgtggcatgctcatcagaaaaggatgaggaaaaattctggaagatacttgatgagagacttgagctgtgtcatagagcacttatgtgcagacataagaggcttcttggtaccaaatccgatgtagcaccgattctctggcagaacggagcacttgcacgtctgaaaaagggagaggttatagacccattattatttaacggatactcaacaatctcactcggctatgcaggactttgtgagtgtgtacgctatatgaagggagtatcacacacagagccaaaagagggaacaccgtttgcacttaaggtaatgcagcgcttaaacgatgcatgtgagcagtggaaaaaggagtcaaacatcgatttcagtatatatggcacaccgcttgagtctaccacctataagttcgcgaagtgcttacagaagcgctttggtatcataaagggtgttaccgacaagaactatattacaaacagctaccatgtgcatgtaacagagcagattaatgcatttgacaagctaaagtttgagtcccagttccagaagctgtctccgggtggcgctatcagctacgtggaggtaccaaacatgcaggacaatatccctgcagtgctttcagtaatgcagtacatttacgacaatatcatgtacgcagagctgaatacaaagagcgactattgccaggtatgcggctacgacggagaaatcaaaatcgtagaggaagagggctcaggcaagctcatctgggagtgcccacactgtggcaaccgcgaccagaataagatgagcgtagcccgccgtacatgcggctatataggtacacagttctggaatcagggaagaacccaggagattaaagagcgagtgcttcatctgtagaagttaaaggaggttattggtgttctgaaaaaagagatatattacattaatagtctgatgtaacataaaaatatgccgtatggcagcttttgaaaatatttcataagctgctgtatggcttttttataaataagtctatattcatgcattcaaaagtgttataatattagttataaaaataattttattcatatatatacgaggtagtttttaaactatggggattaaaacatttgaaacacgcgaagcattaaaaaataaattacataacagaaaacttatcttttcagaaaatgagcttgatgaagttttaatttctcataattattttaatttatttaatggcctagaaactatttttctacaaacatcctctcctaaaacatatgataaagtaaagttgattgatttcattaatctatatcaatttgataaagaaattagatcaatcttatcaaattgcttggattctgttgaagagaagttaaaagcctcaatagcatataatttttgtaagcatcattgtgtttcattatcggatacaatgcaatatacaaataagtctaattttatgaaccctgcaaacaatgaatctgggacaccgacatactgtcattattctgaagcatatccatttgttaattatcaaaatcaaaagatatatcaagattttgataagttttgtctttttaaaccattttttctatctaatttagtagatagaaatgatcatattgatatttcattttatttagacaatgattacgtagcaccttcaggggttgctgtttatcgtaatagtgatggcacttacaacagaaacatcgctgtgccattttgggttgcaatagagactcttacatttggtgaaatattaagactgttgcactatttgcaagatgatgttcttaaagacgttttaaatgattttaatttaccattatcaaaacgtgccccgttcttaaatatgattgatattttattgtgtcttagaaataactgtgcacatacgacgctacttaatagatttcggacggaaaaaagatatcgaattaatgcattattaattgcttcgttttcattaacacctaaaaatgcagattcggtgttaaaattatttgattcaattaaaatattaagcttttttactgacgtatctgcattaaagaaacctttacggacattaaaatttaaaatatatgttagtatgggaataaaaaaggggaaaacagtatataataaaatattagcacgaatgggatgcggagactataaaaaatggaatatagctttatttgaaacaaaatattttttataatttccttgacatttttataaattagtagtataatgcacacaacaaatgagatgcccttaagggcgctaagtaatggaggcattactttcgataaaaaacctagcatataatgctaggtttttttggtggtgcgttgacagatattaaattaaaaagctacggtacggcttttttatatagtaccggaggctctggcaatttgcctatgaaaaaactaaaaattctgatgcatattaatatatttagcttgcataaaaaattattatacttctaaactcgtaaaagtattgtgaaatttccacaaaatctatgtgaatatcattatttgaaaaaccgtttgaacatactaatctttgtacattttcccatatttacaaatattaaattgatgtatttttgctaaatattgcagaaataagttggcatttatgtctattgaaacgtaaacgcttaatgtataaactgtaaatatagttattgcaaccgattgcgctgttgcgcatggaacagatgaaatcatgcgcggcatgcaatttgagaaggggcatgacagtggcttaatggctttgatatttatcaatttgatagtcatttaccactgcataaaaacaaggaggaaaatatgagcaggaagagaaaaatggcatctataacaagtgccggactggtgtttgcaatgcttttaagccagagcgctgtggcggatttgggtacagagcaggttaaggcagcagaggaagacgcaaagtgggtagacacagaatatgtggtgaatggagatttcgagtcaggagcagataattgggagattaatataccaaaagacactgaaaactggctttacggatcgggagcagaaaatggatattattgcatctgggagaataaaacagaggaagaaaaaaatgcatctatctcacaaaccgttaagcttccggccggaacatataaacttggaataaaaagcaccggtgcagcaggtggattaaaactgagtgcaggagaatatgtcagcacagatttaaaggcttctgagtgggctgatgatcagagcaaatgggaatcaattgagacaggagaattcattcttgataaggaaagtgacgtgaaggtttttgtttcaggaaagctgacagcatggaataaaggaagcgcaattgatgatattgttttgtatgaaaaagaagcagatgatactgactcttccgaagaaaacaagaaaggctacacaatctcagtaaaccagactgaagtagccgtagaaaatggtgatacagtcaatcttgaagcaaagattacttatgatggaaaagaaataagtgaacttcctgagggagtaaatttatggtggtgggttgatacatggaatgatcacacagatggattgagtgacggaacattagaaaatgacaatggttccggaaaaacttttaaagcagcctacacaacaaagtcagccggtaagtattatgttgtagcccagcttaaggatgctgatggcaatgagcttggttctgtatgtacaactattacatcaaaggcgccggaaattgatacctcagtagacaatgacgatattgttgttgcaaaggtaaaggatttgtcgcctgatttcataatgggaatggacatttcatctgttataacagaattaggcagtggtgttgtatacaaggattatagcggaaaagaaattaacaacgtgacagatttctgcaaattcctggcagaaaacggcataaaccatatccgtgtcagagtatggaatgatccatatgattcaaacggaaacggatatggtggtggaaataacgatgtggcaaccgcaaagaaaattgctgatgcatgccgcagcgcaggcataaaaatgcttgttgattttcattgctcagatttctggacagatccgagtaaacagatggtgcctaaggcatggaaggactatacagttgatgagaaggccgtagctgtagaaaagtttatcaacgaatcattaaatacaattgatgcatcaaaggatgttgttgatatggttcaggttggaaacgagacaacaggcggttttataggtgaaacaaatacggaagccatgtgcaagctcttttccgcaggctcaaaaggtgttaaggattacaacagtgacgtaaaggttgtgattcatgtggaaagtccacagaagaatacactcacaacgtggtcagataatcttgaaaaatataatgtaaattatgatattcttggaacaagctattatccgtactggcatggtacattgagcaatttaaaggatgaaataagttatgttcagactaagcacaacaaggatgcaatggttgtagaaacaagctacgcatatacacttgatgattcagatggtcatggaaatactgtccgtgagggaaataatgatgactcggcagatgccacagagcctttcacagtgcagggacaggctactttcatgagaaatctcatcaatgctgtaaatgaagcaggtggacttggtgtatattactgggagccggcatggattacagttggagataccacaggtctttcagaggaaactgcagcggcaagatatgaagcaaataaaaagatttgggaggaaaagggctcaggctgggcatcaagctacagcggtgagtatgatccaaaagatgcaggaaaatggtatggaggttccgctgttgacaatcaggcaatgttttatccggatggaacagcaacagcaggtcttaaggtatggaattacgtaaagaccggtgcaaaggtgaccaaaatcggagttgaggatatagaaacagcagatgtcacatcagaggcaggtaaagagatagagcttccaaaaacagtcaatgtgacatataatacagagaaagttgaagagaacgttgtttggaatacagagggaattgatttttcaaaggcaggaacatacactgtagagggaactgttaaattcagcagaaaaatcgagcgtggtgcttataaagataagacatcgggtataacaaaatgtacagtagttataaagcagaaaaatctcattacagatgcagaggatgcaggctttgaaaaggctgataattttactgtcaataacaagattgtcgattcagtttcttccaccaaggatgataagaagtcaggagaagcatgtgctcactggtacaatggtggagaagataagaccgaggctgccattacttacaataaagctattacacttgcttcaggcgagtacatctttgagtatgtaggacagggagccgacggagatgagctttatgctgaggttatggattcagaaggcaatatcattgcaaagggtgacaatgtaacacttacaggctggaaaaactggaagactccaagcgtttcatttaagcttgagaaagaaaccaaagttacacttgttgtcggtatcgtgagtgcaaaaggtggctggggaacagttgatgacctatacttatatcagacaaagtcagctgacaagagtgatgccgataatggtaataccggtgatgatgaaaacaagaagccggataccccatctactgatgataataacaaggacaatacaggtagcggtgataccaacaaagatgatagtacatcaaaggatgacaatacaaccaatggtgatcaggatagcaatacaggaaacggtgatacagccacacagcctgcaaagactcttacaccgggagcagttgtatcaagcacatccgacactaaaacaactgtaaaggacactaagggaatccttccggatacagtaaaattcgagtcaaagaaggtaactgatgagaaggaagtggcaaaggttgcagatgtagtaaaggataaaattgtaggagtaaaggatgttttaatatatgagcttaatctgacagatggcactacacagcttcatcagcttgcagacaaggttcaggtgactatggatatgccgtttgcattagctgacaatgagacaatcaaggtgttccgtgtagattcagacaagcttatagcgtgcacatcaagggtagcagatggaaagcttgtatttgagacagaccatttcagcacatttgcctttgtaaaggtaaataccaatgcaggtactaaagcagctgctgcagacgcagcaaagacctcagatgacagcaatatgtatatgtggcttgttatcgcaatggcaggtcttggtgtatcaatcgcagctcttatgaaccgcaaaaaggagcaggcatagcagtgtttctaaaagcacaacataaagcataagaaaaaaataaaaccgtcgtaccgggccgtaaatggcagggtacgacggttttacttatgtttttaaatgattaattatttcaattactcatcaaatttttgagccttatcgaagaactcataaacctcttttgaaggctcatttgtgcaaagtgtcacaacaacggctgcgataagtcctaaaacaaatcccggcagcagctcgtagattccggttgatgtgaggaatgcataccacaatatatcaacggtagcacctgttatgattcctgcaacagcacccttgaagttaaagcgcttccagaagaggctgagcatgattgcaggtccaaaggcagctccaaagataccccatgcattggaaacaagtgccatgatagagccggcattagggtttgatgcgatgatgagtgctgcaacagagattccaagaacgacaatacggccggtccacatcatctctttgtcacttgccttgccttttctgatgacaggcttgtacacatcactcgagaaagcagatgaagcagcaagcagctggctgtctgcggtactcatggaagcggcaagcactgctgagaggagtatacctgagataacacccgggaaaatctttcttacaatctggatgaaaacaagagagttttcattgattgattcgtcaaagccaaggaaaagtcttccgattactccgattaaagtcgcaaaaaatacaataagcagagtccatgtgattccgatttttgctgattttttcaaatccttctgtgatttgatggacatgaatctgatgatgatatgtggcataccaaagtaaccaagtccccatgccagtcctgacacgatatcctgccagcttgagaatggatttaagtaaccgcccgggagtgctgacatagatgatgtatcaagcataaatgctgcaaaaatcggtgctataaacatagaaccaagcacgagcatgccctggaaaaaatcggtccagcatacagccgagaagccgccgaggaaggtatagcctacgatgacaactgctgcaagatacatggcaatctgtggatccattcctattacagtgtggaaaagagtaccacatgcctttacgctcgatgccgcataaatagtgtatgcaaccaaaaacacaattgcacaaatcacctgcagtgcaagtgatttggacaggaatctgttggtcagatactgcggaatggtgatggagtcgtttgctacaatcgagaattttctcagtctaggggcctctagcagccagcttatagtgtagccgattgcaagtcctacaggaatccatacctgacctaagcccagtgcatagatagaagtaggaagtcccatgagtacccatgcactcatgtctgaggctccggctgacagcgccgcaacccatggtcccatctcacgtccgccgaggaagtaggtcttttctccgccgtttctgtttttcacgaagaagaagataccgatacccagcatgcacagcagatagacgataaatacaataatttctgatgttttcatttgtagtacctctttaatagtttatttagtaaccatgctaccacgttagcgtgataaaggcaagaaaaactttctcttgacgaatacactgcgttgacatatcatagtatataagtgaaagggagtagccggcacgagagtgcttacttatccgtcagtacgattgctcatacatatcatacatatatgacagcaatccggagagtgattaaatggcgagacttttgttgttttatacagcagaagtgtcgccttttttgtatacaaaaaccttctgctgataggacatagctgtaactatcaattaatcaggcatccttaaaaaggacagcagaaggaggaaaattatgatttttgtagcaattttactgcttatagcaggctttgtagcactggtgaagggcgcggatgtgtttgtggatggagcggcggcgctcgccgggaaatttggtattccgcagcttgtgattggactgacgattgtggcgatgggcacgtcgctgccggaggcggcagtcagcatcactgcaggaataaagggtaatgcggggattacagtcggcaatattgtcggcagcaatatcctaaatatccttataatcctgggagtgacggcactcatcacaaatgtagccatacaaaaaaccaccttcaaatacgagataccgtacatgcttcttatcacagcggtgcttctcgtgatgggaatgacaggcaatgaaatcacattcattgagggtgttatactgtggattttatttattgcatatctgctttatttgtattttctggcaaaaaagggcaatgacagcggtgatgagcagtcggtaaagctatatccggtatggaaatgtctgctctttattgtgctgggcggtgtgtgcgtcgtaattggaagccagcttgtcgtaaacggtgccacgaccatagcaagagcctgcggcatgagtgagcgctttatcggactgacaatcgttgcattcggcacatctcttccggagcttgttacatctgtttcagcagcacgcaagggaaatgccggtatagcgattggaaatatagtcggcagcaatattttcaatatactctttgtaatcggaacagtagctctcatttgtccggtaccgtttgagagcaggtttgtgattgatacagttgtggcaatcctgtgcggtgtgctcctgtggggaggtacgataagacataaagagcttagaaagccatgtggagtggtgatgctgctttgctatgcagcatattttgtatatttggcagctatgtaatgatgtatttttttgaattgcgatgactgtgtttaaaaagagtgtgatgaagagataataattaaatttagcaaactgtcaataattgtgcatacaaatcgatgctttgacatcaaaatgattgcgattttgcattaaatataaataattgattaaaaatagcactcttgcttgacaagtgctgattgcaggtgtataacgtagtcagaacgaacggaaggaagcgattataatggataaaaacccaaagcatccattgaagaaaaagaataaggcagatgcaaagaagcatcagaagcatgtatacgaatagcgcttccactaaggaatactatccagtaagcacaatgtaccccagcccgtcacagggttggggtattttgtgtttttggaactgttttcagagactgcccttgaggcagatgtaaatacattttcaccggcaccttttatgagagaggctttaagcttgtcgccatacatatagaggtcatttccacgcacaattccccattccatcagaagcgcagccgcaccggtcacaaacggtgcagccatagatgtccctgtttttgaagtgtagcctccggtgtttgagcatgaaataatgtctacaccgggcgcaatgatatcaggctttatgctgtcaaaggcccaggtatagcctcggccggaaaaggcggctgtgcggtttgtttggctgtcataggctccgacagatatgacattttgagcggttgaggggatggtcagggtgatatcaggcgatgcatggataaatgaggtctgtgcattgcgcagggcacctgacggcagccatatatcccatgagccgtcctttacagatatgggttcaagtgatattttccagatgccgggtgagatatattccgatcccatgagttcaatgaatatttcctgaaaaggagagtagggagagggaccgccgcctgttatatatatgtctgtcccatcgagattgtatctgtatgtaaagccctttgcctgattggtaattgtatcgggaatctccagcatatcattatttggtgcactaatgcgcagctgtatctcatcccagtattttttccataaatcaatggaaagagacggctcaggatagcctatcgcaagctctgcatcggcagggtatgagctgccgtttgcatggccaaagccggctccatcgttacctgagccgactgagaaagcgcagcggtagtttcctgctatatagtccaggtatgcttcaagcagtgaggtgccgctgtgcgagccgttgcttgtgccaaagcttaggtttatggcgataggcatgttcatatcgattgattttcttatgcaaaagtctactgccagcataatctgcgtggttgtgggaaagctggtaccgcctgaggttttgagttttacgattataagagtgctttcataagcaacaccgcggtattttgtattttgttcattaccattaccatttccgtttccggcagcgattcctgccacatgagtgccgtgcccggatatgtcgatgcttgggcagatgcgctgcatttctaagctgttttctgcatttatggctttggtgattgtatcgcggtcatataaggtgccgaaagggaggatatcactgtgtgaggaatcatcggaaacagtctggtcccacagataggcgattctgcttacaccatcctgtataaaagccggatgggcataataaattccagagtcgataatgcctacgagcacaccttttccggtcagattatatggattggtgtgtacgggagtgatgcatgaggcctgcgagccctcgtacacatcgtagttaaactgctttggcttttccatatatatgatttcatcgcacagggcaacggtatttacaagtgatttctcaattacgagcaccgcatagtttccgagcagcctcgtgatgagtacagaaggatacttttcttttattttttcgatgtcacctacatattttactatcacttcccagctatcactctccggcagatagccgcttgaaagccctccctcttttccaagctcataaggggtggacaacagggcggcggacagctgtggagaaattttctcactaaatgctatttccatactaacctccattttttattagtaaaatattaaaaaaatcttaaaagacagatgcaatatatatttggtatgattatgtcataatagtaactattcagaatcaccccacgcacattcgtaaaatcgcacgatactcgtgctttcccgctgctacgcagctaattttactcatatgtgtgggggtggctctattcgagccaccttgagaacaagaaaacctgctgcttacatgcaagcatgacgcatcagcttttttgttctcagtggttctgaatagttacttataatcaattaattataagaaaccgggaggtcgaaatgagtaaaaagaaaaagataatcatttcagtgattgcagctgtgcttatcatagcagtgattgtgtcagctgttgtcattgcaatgacaaagggaaagaatgcagcaaaggcatcgggagtctatgcaaacaaggtcgctgatgtcatgtatcaggcgggaagtactgacaagtacagcggtgtcgtggaagcagccgataccatggatatcaaggctgacagtgaaaaaacggtaaaggatattcttgtgtcagagggggatgaggtacaggtgggtacacctctttttacctatgatacaaaggatcttgctgcgaaaaaggaaagcgccacgcttgagcttgagagcttaaacaatacgctttccggctatgatgcacagatagagcagctcaccaaggaaaagaaggaagcgccaaaggatcagcagcttgactatacactgcagattcagcaggcgcagacacagcagaagcagactcagtacgatattgccacgaagaaggcagagatagaaaagtatgatgagagcatcaaaaatgccactgtaaacagcacaatgattggtgttgtaaagaaaatcaatgagaatcagagtgcagacacagcagatactgcatttatgacaatcgttgccacgggtgattacagggtaaagggcacaattgatgagcagagctttttaaacagtggactcgcagaggggcaggcagttatagtgcgctcgagagttgatgagtcaaagacatggcagggtaccatcagcaaggttgatactgagaatcttcagactgataacagcaattccggcatgtatgatgatggaagcagcgagcagaaggcatcaaagtacaacttctatgtgcagcttacaggcacaggtgacatgcttttaggacagcatgtatatgtggagccggatttcggacagacgcaggtgaaggatggtatttggattgatgagagctatgtcgtaaaggatggcgatgatgcatatgtatggacacttaataaaaaggataagcttgagaaaacaaaggttgagcttggagactatgacgagaatctcatgatgtatgaaatcaagtcagggcttacaaaggatgactatatagtatgggcatctgatgatctttatgagggtgagccggcacagacatgggaagagtacgttgaaaatggcggcggtgaagattcagtctatgacgatatgggtacagaagctcttgatggccagatgcttgagggcactgagggcggtcctgttgatgatggcacaatggacgatggcacaatggacgaaggtgctgcagatgccaccggttcaggtgacgcggaggtacagtagatgattctagaactccagcatatttataaaaactatgaccaggataagctcgtggtgccggttttaaaggatgtttcactccagattgaggagggagagtacgtggcaatcatggggccgtcgggctccggcaagaccactctcatgaatatagcggggtgtctggatctgccaacatcgggcacatatatacttgacggcagacctgtcagtgagcttagggaaaaggagcttacgagagtcagacgggatacaattggatttgtattccagaatttccagctcatgccgagggagagtgcactggacaatgtatgcctgccactcatatatgccggtgtgagcaaaaaggacagaaggcagatgggaatggaggccttagagcgtgttgggctttcagacagggctgatttcaagcctacgcagctttcgggaggacagaagcagagagtggcgatagcgagagcaatggttaatcatccaaagcttctgcttgcggatgagcctacgggagctctggattcaaagtcaggcaagcaggtgcttgagctctttgagagccttaatgagtccggtgtgacggttgtcgtgattacacatgacagaaaggtagccgagcaggcaaagcgcatcgtccacatcatagacggcgagataacagaggaaggacaggaggcaggtaatgaaaaagaaaaagagaattaagatcattataatagctgtccttgtagttgcagttgcagcaggaagcatcacaggagttgtttattacaggaactccaaggggcttgcttccgtcatgagtgtttcaatgatcagcacgacaaacgactacacatccatgaccagtgagggaatggtgtgtgatgatgcatgtcagacaatcaatttaaaggatggacagaaggtgacagaggtttatgtcacaaaggatcagcaggtaaaggccggagataagctccttgcatatgatgtgacgagtcttttgctctcggttgagatgaagcagcttgagatacagagtcttgagaatcagcttgcatcggaaaagcagaagcttgacaagctaaagaacactaaaccggttgaaaagcagcccgagactcctgttatacctgagccacaacctgacacacagccgtctgcgcctgatgaacagcatgatgtgatatctgatttgtcagaggccaaaggaagcggtacagaggtcgatccttatgtatttacatgtacagaagcttcatatgtatcaggggagcttttgaatacactctcagaaaagagcgcggtagcgcggtttgtaataggagatgcgtctgcacctgatatggagcttatcgtaagaggagataggcttggcggctatgatgaaagcgatgagataaagcttttccttgcaggtacaactacagcaggagatgcttctgatgatacagaaggaagtgagccgtcggataccaaaacagacagtgccacagaacagaccgcacagacagaagctgataccgcggcagaagaaaagacatacacagcagatgagcttaaggatgccataaaggagcagaccagaagtgttgccgatgttgatttacaaaagagaattgcacaggccgatttaaaggaactgcagagcgagcttgaggatggcgtggtatatgcaaagaaggatggaattgtgacaacagtcggtgatcctgccaatccaccgcaggacggtacacctttcctgcagctttcgggagcatcaggactgtatatcagcggaacaatcggtgagctggatctggatacggtaaaaataggacagagcgtatcagcagtcaactacatgacaggtgatacctatgagggcacgatatccgagataagcaatgtgccgtcagacagcgtaaactattatggagacagcaatccaaactcctcattctatgagtacaccgcgtacattgagaatccgcagaatctcaaaaagggcgattcacttgagttgaccatagatacatcatcggagggctctgacagtggactatatatcgacaagtcatatgtcagaaccgagaacggacagtcatatatatacaaggatgacaacggaaagctcaaaaagcagtctgtcaaaacaggcaagtcactctggggctcatatgtggagataaagtcaggtctgacaaatgatgactatatcgcattcccgtatggagtcagggatggcgagaaaaccaaggtgtcggaagatggtatgtattagtttagcagggaggattaaagatgcttgaaaatattagattgtcctttaggggaatctggtcacataagatgcgttcgtttctgaccatgcttggaatcatcatcggaattgcagcaattattgcgattgtttccacaattcagggcacaaacgaacagatagaaaagaacctcataggttcgggaagtaataacgtaaaggtcacactgcagaaggatggctatgatatggatctatcatatgaaacggcgccggcgggagtgactgaggtatcggctgccacacttgacagcataaaggagctcgaccatgtgaaaaatgcagctctttaccgtacaagacaggcttccaatgcagtctattatctgaacacggcgctttcgggcggcaatataacaggtgtcgatgacggatatttcgatactgcaagctatgtagtcatgaagggcagaggcttctcaaagaatgactatgcaaatgcacgcagggtggctcttattgatgagagcgtggagagcagcctgttttcaggagagagcgcactcggcaagacagtagagatacagggatatccgtttacagtagtcggtgtagtcacggaaaaggacagctatgacctggtaataaactcaatggatgattactatatgtatgcccatgatgacagccagggcaatgtatttgtgccaagcggaacatggccggttatatttggttatgatgagccgcagaaccttttgcttaaggcagacagcacggataccatggctacagtgggaaaggctgctgaggagatacttaacagcaatttaaatgttacagacggctctgatgtgacctacaaggcacaggatttacaggagcaggcaaagcagatacagcagctcagccagtcaaccaatatgatgctcatatggatagcaggaatatcactgctcgtcggtggtatcggcgtcatgaatatcatgcttgtgtcagtcacagagcgtacctcagagataggacttaaaaaagcaatcggagcaggaaagggagcaatacttggacagttcctcacagaggcagttgtgctcacaagtcttggaggtctggtcggagtgctggtcggagtgatactctctaaggtcatctcaatgctaaacggcacgcctacagcgataagtccggcagcagctatacttgcggtgcttttttccatggcaatcggaatcatattcggtatgcttccttcatacaaggcagcgaacctgaatcctattgatgcactgcgccatgagtaattcttattgaaatcgctgctattgtgaaaaaaataacaattctttgtattttgatgaatacaagggtagaaaaagtttaaaaaattttgtaaaatgttcctagtagataaatactaggagcatttttttagaggaatcagctcatatgatatgggaagtgtcacatgatgtaatgattcttctaagtatgtaaatcattaggtaacaatatacatttattttaaggaaaaggagataatatgtacgctgacgaaaacgtaatcaaaatcaaacatgcagttttgcttgaggtcgcaaaggctgcatttgcaggtaacctcgatgagatcagagatgacatcccgttcacactgattccgggaccgacacctcagttccgttgctgtatctacaaggagagagagatcatccgtcaacgtgtcagacttgcagagggtaaagcaccaagcgcaaacgatgacggcaatatcatccaggtaatcagctcagcatgtgaggattgtccaatttcaagctacacagttactgagaactgtcagaactgtcttggcaaggcttgtatcaatgcatgtaagtttggagcaatcgaggcaggacgtctccgctcacatatcgacccacagaagtgtaaggagtgtggtcgctgtgcacaggcatgtccttacaacgctatcgctcatttaaagagaccatgtaagttctcttgtcctgtaaacgccattacatacaatgagtacggcatttcagtgattgatgagagcaaatgtatcagatgtggtaagtgtatccacagctgtccattcggagctatcggatcaaagacatacatcgtagatgtaatcgatgcaatcaagtcagagaacaagcatgtatacgctatggttgcacctgcagcagagggacagtttggcgcaaatatcactatgaacagctggaagaaagctatgcaggcagttggcttcaacggttttgttgaggtagcgctcggaggagatatgacagcagcatacgaggctgatgagtggcttgaggcatatgaggcaggagagaagaaggttacatcatgctgtcctggatttgtaaatatggttagaaagcactatcctgagcttgctgacaagatttctacaactgtttcacctatgtgtgcagtttcaagaatgataaaggcaaaggaccctgatgcagttacagtattcatcggaccatgtgttgccaagaagtcagaggtacatgatcagaagatagagggcaatgcagactatgtacttaccttcagcgagattcgtgctattatgaaggcaaagggagtacagcttgaggctgatgatacctcatatcaggagggctcagtattcggtaagcgtttcgcaaactcaggcggagttacagcagccgtaatcgagagcatgaaggaaaaaggcgaggatgttgattgtaaggtttgcaaggcaaacggagcagcagagtgtaagaaggcacttctcctcatgaaggcaggcaagcttcctgagaacttcattgagggaatggcatgtgagggcggctgcgtaggcggaccaagttcatacaatgacatggtgactaccaagaagttccgtgatgatctcttaagcagagcagatgacagaaagattcgtgacaacatcgccaactaccatatggagacatttgagatgcaccgtaaggagcagtaataaaatgattgttacagcataagctttttaaatcccccgactagttcgggggatttttgtgattgcgaatatctgcaaaaagatatgtggttagtcatattgagaactgaatagtaacaaagatattaaataaattaattacttattaagactgcaccggaggtattcatgataaagaaacaattgtaacataactgaaatatatgaagccaacattaagaaattctcaaggaatttgcagtagcaaaaaagattgtttaacgctataatagatactgcttgaaataatattatcaggtttgagtaataatatagagagaataattataaaatgctaaagaggattggaaaaatggacaaaaataaaaagatgattatcggcatacttacggctgcaatagttctggtggtggcgtttatagtgtatatcacatgctttgattcacatattgagttcagcagcaagttcaaaaacggtattactgttgagtatggcaaaaagtttgaggtaccaaaaatcaaggcgtatgtcagaggcaggcttataaaccgaaagggaaaagagataaaatgcactatagacagtaatgtcgatgcgacaaagacaggttcatacgagataaaggtaactgctcaatacggtaaaaaaactgcgacacagaccatcaaggttgaggtgagggataagaaggctccggagattacattaaatggcgatgcagagatgactttagaggcaggcagcgagttcagtgacccgggatatacggcaacagacaactatgatggggatctgacagacaaggtatctgtcacaggagctgttgatacttcaaagccgggagactatgagataaagtacagtgtcgctgactcgtcaaagaatgagagcgaggtcaaaaggactgtgcatgtcacagataccactgcaccgcagataaagctttcgggtgatgattttatgtcagttaaaaagggggataagtacagtgatccgggatacacagcaacagacaattgtgacggagacatcacagacagtatcaaggtatcaggagataaggtagataaggataaggcaggaaagtatactgtgatctatgaggtctcagattcatcaggaaataaggctactgctacaagagtggtaagtgtgtatgatccggctgccacggcagacacggtaaatccgggcaacaagattatttatctgacctttgacgatggtcccggaaagtatacacaggggctattagatgtgcttgataaatacaatgtaaaggccaccttctttgttacaaatacacatcctgactatcagaacatgatagcagaggaggcaaagagaggacatacagtggctatccactctgccagccacaaatacaaccagatatatacaagtgagcaggcattttttgatgaccttgagcagatgaacagtatcataaaggcacagacaggaaatgatgcgtcaatcatcagattcccgggaggctcatcaaatactgtgagcaaggattactgtccgggcattatgacacagctcgtaaatgatgtgacagcaagaggccttttatactgtgactggaatgtatcgagcggagatgcaaacagtaagccaatcagcacggaacaggtagtgcagaatgtcatttcaggagtgcagagccacaacgtatcagttgtattgcagcacgacataaaggatttcagtgtcaatgcggtcgagcagatcatacagtggggacaggcgaatggttacacatttttaccactcaccacaagctcaccgatgtctcatcatcgtgtaaacaactaaaatcattcaaataaaaaagcacaaaaaagaagagttcgaaatgaactcttcttttttaatcatgattcttatatcttattccccaattaacatttttgtaactataattttacctaaatatataataaagaaaaaggtacatagaaactagattgcctgaggggtcaaaattatttaactacctcaacgttaactgcctgtggacctttagcgccatcagtgatatcgaactctactgctgcaccttcctcgagagttttgaagccctccatgttaagtcctgagaaatgtacgaatacatcctttccgtcctcggctgtgatgaatccgtaacctttttggttattgaaccattttactgtacctttgctcatcgaaagtacctccaaataataataatgctgcttacgcaactaacgttagaatagcataacgggtttaagatgtaaagcaataaagtcaaagttctttaaagtttatgtcattatttgctaaaaatttcattacaagcttatcccattcaccgtctaaggtcttatccgctgaaaaaatattgtaggatattccggttgtcagagtcagaagctggctctgatacctgatatttatgaaaaaaccactgatatcggacacggtgaaagcagagtgcagactgcttagggtgtgctccatattttcaggtgaaagcagaaagacaaacttgaatgacgatggagtctgtcggccctttatcaggtcaaagcagtttgtgcgaagcatcctaaaggggagtatgctatagcccgctataccattttcctcaagctctgtggagctgtaaaagcccttttgcaggtgaccatctatgacgtatgaggctgcctttgtgatgacggcctcctggagcaggaagttgtcaaagatttccgtgcgaagcagcttgttcataaagtcctttgtgtctgtcagttcaattgatatcataatttctcctcattttccacattgtatgtgacagcgaatgattgttctaagtggttttgaatagttatcgattactatatcatacatcagattcgcggattatgccataaaaatagatataaaaatagccttaaaaataaagcctgttcaactggaataattgtaaagtccgtggtagaataaatgcgttatgcaatgaaaacaggaggcaatccatgaaacaggaaaaattatttgatttactaaaagcggctgtttcaccatgcgagtgtgtgaaggctgcaaagcaggagcttttggaaaacggatttgaggagatagattatacaggtgactggaagcttgtgcgcggtggcaggtatgtcttaaatcaccatgatacgaccatgtttgcgtttacggtaggaagcggctacaacaaaaaggatatggtgcgaatagcggcagctcacacagactatccatatcttcgcataaagccaaatccggattttatgacaaactcatatgcacaggttaatgtagaggtgtatggaggaccgattttaaacacatggtttgacagacctctcggagtggcagggcgcgtggctataaagagtgaggatgtgttcaatccgcgtatggtgctctacaggtctaaaaagcctgtcatgattattccaaatcttgccattcatatgaacagggatgtgaataagggtgtcgggataaataatcaggtggatctgatgccggtgcttgattcaatacctgaggatgaaaggaccacggattatttccttagctttctggctagagagctgtctgtggaaaagagcgatatcatagactttgagctcaatacattttgtatggaggagccttgttttgtcggtgtgaatgacaccatgatttcatcaccgagaatcgacaaccagtcatcctgcagggcacttcttgatgccatagaggatggaaacagagctgatggaataaacatcatagcgctttttgaccatgaggagattggaagtaacagtaagcagggcgcggcctctataatgcttcacgatatgctcagacgtattttaagaaatatggacctttcagaaaatgaaatagatgagagcatatatgatgccatgcttttgtctgttgatgtggctcatgcgcttcatcctaataaaaaggaaaagatggatatcacaaataagcctgtcatgggtaaaggcttttgtatcaagcaggcgtgttcgcagtcgtatgctacggatgcacaggctatcgccattctctgtcagctgtgtgatgaaaagggcataccttaccagcgttttgtgaatcgttcggacagccgtggcggcagcacactgggctcgattgcaggtacgcttctgccggtaaagactgtggatataggtatacctattcttgcaatgcactcagcctgtgagcttatgggagtacgcgacatgaaagccttaagcgactgtgtgacggcctttttcgggtaccattaaagggcagataaccattatgggaaaataaatacagaaacctcttgcataagtttagttttcgtgttaatatgacgtagtaatgaaaactacttgttacggaatgaaataacttttaaaaaagtaatttaaacttttattatcatatagtgcaggaggaatagatatgtataagattataatagatagctgtggtgagctcacagatagccttaagaaggatggacatttttgcaatgtggcactcgagcttgatgttgacggatacagaatccgcgatgatgagagctttgaccagcatgatttcttaagaagagtaaaggagagtgtaaagggaccaaagtcgtcatgcccgtctcctgaggaatatatgcaggcctttgagggagaggctgaccatgtatatgttgtcacactttcgggcaagctcagcggctcatacaacagcgctgttttagcagtcaatctgtacaacgaggagcatgaggactgtggcaagcaaatctatgtattcaattcccgctcagcatctataggcgagacactaatcggcatgaaggtacaggagtttgaagagagtggactttcatttgatgaggttgtaaagcagaccgaggagtatatttcttccatgaataccttctttgtgcttgagacacttgatacattaagaaaggcaggacgattaagcaacctgaaggcttttgtggccagcactttaaatataaagcctgtcatgggctcaaccgatgagggttcaatccagcagcttggccaggccagaggcattaagagggcacttgccaagatggtagaggatgttgtggctgccacaaaggactgtgagcacaggattcttgcaatttcacactgcaactgcccggagcgtgcacagtatgtgaaggcatgccttgagaagcttgccagatttaagaagattgtcattgtggatactgccggcatctcaagcatgtatgcaaatgacggaggcattattatagcagtataaggatatggtctttattttatcggccggatatattataatgatggcatgggaaatttagattacacacaggttttaaacaaaatagaaaacacacgccgtttcggcaatgagccgggagtggtggtgacagcacaggtcataaaggtgctgagagaaaaaggaaagcaaaagcgcataataccgtatatccatgtggcaggcaccaatggaaagggctcggtgtgcgcttttttttctagtatattaaaaaaagagcatatgagggtaggcacgtttgtatcaccgcatctggtagattttgaggagcgcatcacggttgatgggcgtatgatagctaaggaggatgtcacacggcttggaaactatctgcttgatatggattttggcataggacttacgatgtttgactactgccttgccatggctcttttgtactttgaggagcagcagtgcgattatatggtcattgagacagggctcggaggcagacttgactcaacaaatgcaatcggcacaccgcaatgtgccgttattacaaagataggctatgaccatatggctatccttggcagtgatatagcggatatagcggctgagaaggccggtatcataaaggaaaacagcacagtggtggtggaacagcaggataaacgtgccatgcaggtgattgagcaggaagcgcaaaaaaagcatgcacggataattactgtggagcaaagcgatatagcacgctgcagcggctatgcactgaggctttgtggcacatttcagtgggagaatgctgcagcggcagagcttgcggcgcggtatgtgctgggaaagcactatggcgggccggaatatgaaatgcaatatgataagacagggccaaagagcgagaaaacagacctgaatgacaggataaagagtgcacttgaagaggctgtgtggccgggacgcatggagatagtatcaaaggagccgtttctgctggtggacggagcacacaacagcaatggagttgatgcgctcaaggaaagcctcatgcagatgtatccgggtgagaaattttgctttttcatgggagtcatggctgataaggactatgatgtgatgatacgtgagattttgccgcttgctgaggagttttatacagtgacaccggattcagacagggcactgcaggcatcgcaccttgctgattttatcagaaaagagggagttgaggcaacagagctttcaggagttgatgagataagtaagcacctgaaaagagatacgaaaaatgttgcatttggctcattgtattttattggggagcttaaacagcaccggatataaacaccggatataagaggatgattcatggctgatattttaagaatttttaaaagagatatgtgcggcatattccgaaatgtgcttgtactcattatagttattggactttgcgtgctgccggcgctgtatgcatggtttaatatctatgccaactgggacccgtatggcaacaccggaaatatagcaattgcagtagtcaatcttgacaaaggctggacgaagaatgacagcgaaactgtcaatatgggcgatggtgtggtagagtcattaaagcaaaaggatactataggctggaaatttgttaaatcagaggaaaaggctgttgagggtgttaagtcaggcagatattattctgcacttgtcatagatgagcagtttacctacagcatgtatcatggtgtagctgataatattgaaaatccaaggattacctactatctcaacgacaagaaaaatgctgttgcgacaaagataacggacagcgcagcaagtgctgttaaatcaagtattaataagcagtttataaaggtgcttgcagagcaggtatttaaggagaccaacgtaatatccgatgacatgaaggaaaaggatgctgtggggcagatgaccggtaagcttgaagcggtatcagagagtcttgcgcagtacgatgccatgatagatacgtttattgacggaaataaggcgttgtcacaggtgtctaaagaaacgggcgaagcactcaaagatgggcaggataagcttgcaaatggcacagacaggcttgaagagagtaaaaatgatctgcagtccaccagacaatccttcgacagctttagtgcagatatcacatcggcattagcaaaggtgaagagctcgattgatgatatatcaaagcagatttcagatgcaaatctgtcacaggatgtaaatacgattcaaagtgatgtgcagaatattaaacagtcagcggatgctttgaaaggtaatattgacactcttgaggacaaaatcaacaaaattaagccggatatggacgatacccatgtcggcacacttatttccaatatagagcttgtcaaggaacagacaaagagcatgatagaaagcacacagtctgtggatttatcgggaaaaacacagaattctgcagaaacacttaagagtgtaatgtcggctctttcatcgaccgcgtcagcagtgaatgatacatatacctcacagatagtgccacaggtggacggcatgataagcagtatgtcgtctgttcttgattcaatgcagaccacacttggcaatctaagtcagacatcaggctccatggcgcaggtgtttgacggagtggacagtacgcttgatacactcaatatgagcatgacacagcttaagggagttatagaatcagcatctgacaagataaatacgacactcgacaagcttgaagcagcctctgaggatgaaaaagctgatatcatagtgaatctgctttcggggaatcctgaaaagcttggcagcttcttttcagagccggtgcaggtatcagataattatatatacgagatagccaattatggctccggagtagcacctttttacaccacacttgccatatgggtgggcatgactatacttgtttcactggtaaaggttcacgcggatgccaaggggcttgggaaactaaagccttcacagctttattttggcagatatctgacattctttttactgtcacaggtacagacttttatcattgtgctaggtgatttatacctgcttaaaatacagtgtgtgcatccggtttcatttattgtgacaggcgcagtgacaagccttacattttcactgctcatatattctctgaccatatcctttggtgatataggaaaggcactggcggtggttgtcatggtacttcagattgcaggaagcggcggcacatatccgatagaggcgctgccggcatttttcagggcagtgtatattttcttcccattcccatatgcgataaatgcgatgagggagtgtataggaggtatgtacgaaaacacactcggcaaatgttatatcacgcttttactttttggcgcagcctctttggtgataggacttgtgatacgaaagccgtttatcagactcaatcattttatagagaagcgtatggaagatactgagatgctatagttaaatgtacaattaataaattgataattggcatattaatatggtacttctgatgtgccgtaagctataaagcgggaaggaaagtatgcaggatacaggtagaaacagtaataaagattccaatatggataatgatatgaataataatgcaaataataatgtgaatgagcagccgctatccgatgataagagactgcgcgagatgtatgataagctggtcggatatgaaaagaccattcacgagcagaatcaaaaacggataaaaataggattaaggtgcatatacatcattccgctcttttttcttgttctgctgatgattgtgccggatagctcaaaaatcatttttcttgtactgtggatagtgagtctgtttgctatcgcagtgtatttaatcggagtcgagtatgtggactataagctgcaggagaagatgaatgagataagcggctgtgatgcacagagtgtgagtcctgtcgtgcagattgaggacagggtgcaggaaatagccgaaagagtggagcagaaatttgatacgatgcagcaaagtacaggggaggatgccgagcaatgaaaaaaatatttcaaatatatctggctgacctaaaacgcatatctacaaatgtggttgccatagttattattatgggtcttggcatcatcccggctttgtacgcatggtttaatattatgtccaactgggatccttacggagaggaagctacatcacagatgcacatagcagtatattctgaggatgaggggatgagcgtcggtgatttaaagctatgtatgggagacagtgtcataaaggggctgaaggaaaacgatgcaattggctggattttcacagacagcagtaaagaggcactggagtatgtttatagtggaaagtgctatgcagcatttatagtgccgaaggatttttcagctgatatgcttagcttcctaagcagtgagccggtcaatccgcagatagaatactatgaaaacagcaagaaaaatgccatagcaacaaagataacctcaaaggtcaagaccacggtgcagcagtctgtaaactcttcaatggtgagcacgattacggagatagcgtcaaagtcgggagagctcatagtgggagacggtaaatcaggcgataacctggccggaacagttgttgataagctaaaggatatggatacgactctttctacatatgcaggcatgctcgatacatttgccatgctcacggattcagcagacagcctgataggctcgacacagtcactgcttccgagtgtgcaggggctgattgatgggggacagtcatcggtaagcggcatgcagtcatcggtgctttcgggggcgcagacagcacaaaccatcacacagatggtcgacataagcttatcaaacataaacagccagctcgatgtgctggaaaactctatacagctcttaaatgcgtcgggattagcggatgccgatactgcggatatatctgtttctgtggcaggctttgatacggtagaacagcttgctgagaatactcttgccgccattcaaggcttaaagggagtggatagctcgcagatagaggctgtcaggaaaaatatccaaagcattaaaacacagataaaagaccttaagtctgatactgaattgacggcagataagctaaagcttcttaaggaatcaataaaagccgatgtgtcaggtgccaagtctgcaatagatacacttaaaaatacatttgaccatagtgtatcaccgaatctcacaggagcggtatatgatatagaatatgcacttattgagacacagtccatgcttggttctttggacaacagcttcccggatatacaaaaagcactagatgattattcggtggttcttaaatcaggaaatgcagatattgtaaataccagacagtatgtacagcagatcagagatggtttgcagaatgttatatcaggatttgataatttatcaaacgatgagcagtttaatgagattgtaaagctgcttcagacagatccgacactcattgcgcagtttgtgacatcaccgctgtctatggatgagcagaagatatatgagatatccacatatggctcagctatggcaccgttttacacagtgctggctctgtgggtgggaggtctgataactgttgcacttgtgaaaacaaaggtaaaggacactgacgatataaaatcacttggcaaagtaaacagcgtacataagttttttggcagatatatcacattttttgtgataggccagattcagacacttgtgacagtgctcggtgatttgttctttgtcggaatacagtgcaggcatccgttccttttctggtgtgcaagcgcactgacaagccttgtattcacgcttcttatgtactcactcacagcagccttgggcaatgtgggacaggctgtagcagtagtcattatggtcattcaggtggcaggcgcaggtggcacattcccggttgaggtgctgccgcaggtgtacagagcactgtataagttcatgccgtttaactatgccatgaatgccctaagagagtgcgtgggaggcatgtaccgctttgattattgcaaggatcttgcgattcttcttatatttatagcaatatcgcttgtgatcggactgctgcttgggcgtccgtttggaaggtttaatacagctattgaaaaaagtaagaaaaagtcaggccttatcttataatagtaaaaaaagctatatagaaacttaagttatggttattataaaaaaatagtactagacattttttttctattgtactagaatgagcataaatgatagtagacccgatatatgataacgctaggttatatcggatccgtaaagaaacggaggatataaagatggaaaagaaggatatcgattggtcaaaccttagttttggctaccaggaaacagattacagctatgtttctaattataaagatggaaagtgggacgatggacagctcacaaaggatcatacagtgacacttaatgagtgtgcgggagtattccagtatgcacagacatgcttcgagggacttaaggcatacacaacagaggatggcagaattgtctgcttcagacctgacttaaatgcacagcgtcttaaggattcatgtgagagacttgagatgcctgtattcccggaggatagatttgtaaaggcagttgaggaagtagtaaaggcaaatgctgcatgggttccaccatacggctcaggcgctacactctatatcagaccatacattatgggaacaaacgcagtaatcggtgtaaagcctgctgatgagtatcagttcagaatccttgtaacacctgtaggaccatacttcaagggtggcgcaaagccaattacaatccgtgtgtcagactttgatagagcagcacctcacggaacaggacatatcaaggccggactcaactatgcaatgagtcttcatgctattgtagatgcacatgcacagggctttgcagagaatatgtacctcgatcctgcaacacgtacaaaggtagaggagacaggtggtgcaaacttcatctttatcacaaaggatggcacatttgttacacctaaatcagacagcatcctgccatcaatcacacgccgttcactgatggtagttgcagagaagtacttaggactcaaggttgagcacagagaggtgctctttgatgaggtaaaggattttgctgagtgtggactttgcggaacagcagcagtaatctcaccggtaggaaagattgtagaccacggcaaggaaatctgcttcccaagcggtatggatgagatgggacctgtcacaaagaagcttcgtgacacacttacaggcattcagatgggacatattgatggaccggatggatgggttcacgagattaaatgtgattaattaagtgtgattagtaagaatatgcatttataataaagcaccgggtattatgttacgtcgtaatatctggtgcttttgtattattttatgtggcataataagccgatttgtgctaatatactcttatatgtatgcaaatgtttataaaagcttggaatagctatataaaagcaaacaaaagagataaccggggataattaaatggacgagtatgaaaagataagacagagaaagcgcgaagaatatagaaagagacaccgcgcccaggttagaagaaagcagcttattagcaatggcattgttataggcgtgataatacttataattgcaacgataatcatagtgggagctttaaggggcaaaaaggcaaagcaggaagaggtaaaggcagaggtgaccagtactctttacaatcctatacagccaaagcttgatgtagcgctgctgacacccaatccgtattccagaccacagaaggcactagagaaggtaaacggcatagttgtccattatacagcaaatccgggtacgtcagccagacaaaacagagactatttcaatggcctggcagagaccaaaaagaccaaagcaagctcacactttgttataggattagagggtgagatagtgcagtgcataccttgcaatgagatatcgtatgcatctaataacagaaacagtgacacaatatcgatagagtgctgtatagaggatgagacaggaaagtttaacgacagcacataccagtcgctcatagagctcaccacatggcttatggggcggtatgatctgagtgctgatgatgtaataaggcactacgatgtgacaggcaagaagtgtccgctatatttcgtggagcatgaggatgcgtgggagcagtttcacaaggatctggatacatacatcgaagaaaatggtgtgccaaaggaagaggcaagccaaaactgacaatatacaataaattaaaggatgatttaaaaaatgaaggaaattatcggaaatctgttaaaaaaagagaatgtacgtcagaatctgagcagcctcagacaggagattaaagatgaaaatgcattagcagaggctctaaagctgcttgcaggagaagatgagctgcttgtgtcgtttatgggagcagaagatgcaaaaaccagaaagaacgcagcgcttctgataggagatcttcatatgtcacagctttctgatgaggtttttaaagcatacgaggctgaacagatgcgctttgtaaagggctcatatttggcggcgctgtcacagctggactgcaaagagctcttgccacagcttatggaacgtgcaaaagagcttgagcatatgacggtcacagctgaaaataggaagcatattgaggaagaattaaacgagataaataaaatcctgattaaatataatgggataaagcaccatacacctgtgctcgagggagtaaaggctgagctgcttctgatgacaaaccgccttcacagagaggtggtacgacgtcagataccggttaaggatacaaagttgcatccacttggagtgcttgtaaagactgacaatatacctcttatcatgcaggtgcgcacattcagaaaaatgtactttaccatacatgcagcatcgcttctgccaaaggatgcacaggaagcagccggacttcttgcagagtcagatatgtatgatatattaagacgcatgcaccgtgagggtggtccgttttactatcgtattgagagcacggcagatgcggcctaccagagcaggcttgcgaaagctatcgatatgcattttgcgggcaggatgatcaattcaccaaatgattacgacgtggtgattaagctcataccaacaaaaaatgacaattattttgtctgcatgagattatgttctatacaggataatagatttgcgtacagaaagaatgtgcttcctacgtcgatgcatccgtcacaagcggcacttattgtttcacttgcaaagccgtatcttaaggaaacggcacaaatcatggatccgttctgcggagttggtacactgcttatagagcgcgcacatttagtcccggcacgcgagatatatgctacagatacctatggagatgcaatcactatgggcagagagaatgctgcgtttgctaaaacaagaattaattttatacacagggatttttttgatttcagacatgactacaaatttgatgagctgattacggatatgccggttcgtaaccgacagaccaaggcggagatggagcttttttacgagaggtttttcgacaaggccgcagagcatctggtatccggcggaatcatagtcatgtattcaaatgagattgggtttgtgaagaaacaaatcaggctgcgtgtcgaataccgtctgcttcaggagacatgtattctcgataagaatgacttttatttgtttgttatcagatatgaggattgatttgcgttagtttttaggaggaaaatatgtcagattccaagctttttcaaaaaatacaggattatttctgcatggtcaacggaatatatttgtcgtgtctgacaaaaaaggatggagtcatgacagaggtgtgtcaatgtaacgataaatggaagagtatgcttacctttattggtgaggaaaaatacgaaaaccttcttttgagactgtcggactgcagggttgagaatctcatagatgaacctctggataaggactatatcaggctgtatggtctgattgtaagagtggacaatacccacgatatatattggattatagctgcggtaattgatgagcagatgtctaatgatgagagaaacctgcttcctgatggcataattattaccagtgaagcgcgtcttaacagaacaattgagttcctggaaactatgaccagacagcttttgatcacaaagagagatgaggatgctgcgaatgaggcactttcgcttatcaggaagtcagatgaggaaatcaagaaacagtttcatatgcttgaggctatcaattctgttataaaactgcttgagatggatggaagctttactgatatggctcaaaaagcactggagagtgcagttactaccataaagcttaccggtgcttttatcatccgcaaaaacgtggacggcatgcatttggatgtgattgtaagctatggcagaaagccgtttgatacaatatcaattaccgaggtgccttttttcaccggaaagccttacattatatcatcagactctgtgatgccggagaaattccgccttttcatggagaagcaggctatgagggcagctatattccagcctgtaaatatagataacaggactcagatgtatgtgtgcttttttgatgagaaggatgacagaagctgggaaaaatatgatgtgaagtttttaaatgatacgaagcgcgtcattcaaagtattctcacaaaaaagataacaaccaactcgcttgcaggctcctatgcttcgctcgaagcgatactggaaaactccggctgcggtatatacgtggctgatatgtctaagtcagagatactttacatgaataattactgtaagcagctgctttcaaatattatcgaacagaacaagctggaaaaatatattttttcccatactgcagagagccggagctttacagaggtctacgtgacggaggaggacaagtggtttgatattcatcgcacaggcatagcgtgggtggatggccgcaaggtgcagcttgttacaatgtatgatatcacacagaagaagcgttatcagcagcgcattgagaaccaggccaataatgatttcctgacagggctatataacaggatgagatgtgagcaggatctggctaagtttatagatgattcagtgaaaaacgacaccagaggtgcgatgatttatatagatctggatgatttcaagcatataaatgacgggcttggccatcagtacggagatgtgcttttaaaagctatatcgcatagcctgacacaggtgaagggaattgagaaccactgctacaggatgggtggcgatgagtttatcgtcatagtgacaggcagctctgttgacaggctggagagtatcattaatgatatacagcagatatttgtcagaccgtggttcttgaagggagaggactattactgtacaataagtgccggagtggcatttttcccgacagatgcaagcactgtggaggatgtcataagaagagctgatatagctcttttcaatgctaagaaagaaggaaaaaaccgtatagagttctacaacgagggtattgatggcacaagcacaaagcgtcttgacctggaaaagcacatgagaaaagccacaatgaatgagtgcgatgagttcaccgtgtactttcagccgattataaacgtgaagggggaggatgtctgtgcaggtgcagaggctcttgtcagatggaattcagcaaccatgggctttataaatccggttgactttataccgcttgctgagtatcttgggcttataaacccaatcggggagcatgtattaagagaggcagcgaagcactgcaggtactggaatgacatgggacatcctgactacaaggtcaacgtaaatctgtctgtggtgcagctgctgcagaatgacatagtcaagaaaatcaaaggcataattgatgaggtgggcatagaaccgggaaatctgtgtcttgaggtgacagagagtctggcaatcaatgacatggtgcgcatgaagcggatactcagtgagataaaggcgcttggtgttaaggttgcactggatgattttggtacaggatattcatcactcaaccatatcagggagatgcctcttgatatcattaaaatagataaatgcttcattgagcatcttggggaggatgatttttctgatgcatttgtcaagatggttacagagcttgccaacacaataggagtacatgtctgcgtggagggagttgagactgacaggcaatatgctattattaagaagatgggaatatattacatacaagggtatttcttcgataagccaatgtgcatagaaagctttgaggagaaatatatctgacgaagaaggtgtaacatgcaagaagaagatatagaaaaagcccatgctattcattttggaagaaaaataaacagtgcacgaactgtatcacggccaagaccataaaagataaaaggcagcgtgtcaagatagagttttcgggcactgattcgtaccaggtcatatcaaggtattacaatatagaatgcaagaactacgtgatggagcttgaatacatgaacaagaaacactggattgatgatattcctgttctcctacagtgtctggtcaatatacaggaccggataaaggcggggctggactagcttaaatgcataataaatgaaaaaatatatgtaaaaatagaaattaagtgttgacatatttggtttgatttgatattatatcaaagtcgcgtgagacaagcgacagaaaatcaaatatatgcggaagtgtcggaactggcagacgagcaagactaaggatcttgtgattattgcaatcgtgtgggttcaagtcccatcttccgcattataaaattaaaaagggttaagccttagggcttagccctttttaattttagaagcggaagcggaccttgttcccatgggtccaaggtctccgctccgcttcggtcggcgcagagcagacatcccccggatgtcttgcgccccatcttccgcatggcttcggttgttgcgtggcaggcgcccatggttcaaggtctcgcctccggctcggtcggctcgtggcatgaggtcccccggacctcactcggtctccgctccgcttcggtcgttgcagaacagacgtcccccggacgtcttgcaacccatcttccgcatggcttcggttgttgtagggcgagtgctccatggttaaaggtctcgcctctgcactccatcttcagcgttaaaatgggggaagctaaattatacggatttcgtttaaaattgcatattagatcagaaggagaggacaagctaatgagtcagaaaaaatacagtttattatacccggatacaaatgcacaataccggaccttgagtgatgtgactatgcatgatctggggatggatcaaatctgcaaaaagctgtcagcaaaggagcgggagcagaactacatccaaaacgtgatggcgcgtttgtatgcagatccggcggtgacacagtaccgctgcgatattttcgaggatgtccttcaacagaaaaaaatgcgtgatgatcttatggaaatactcgagcgcatcagctttctgagggagtacggtagctttaaccgggaatatgatgagagtgcctgcatctgggatcttttgcatcggctggacgagcttaatgattatatcgagtgtgtggatgcgcttcatacatgtctggcagcttcggacattcattccgcaggctttctgggtttaaaggcctatgtggagaaaatctatgcggacaacggatttgcagaactgaaaaaagatatctcagaactgaaaatggacacttcacagcttaagagcattacggtaggtattaacttgaatgaccgctttgaagcggacggaatcggtctgatatctgtaaacagcaaatattttaccaagtccggaatcctgggcaatttttatgaccatattgcgtcaaagaatcggatcaatgaggataccatatggaaaaagaatttcaaatttcagccatttgatgtgaatgcagatgcggtgattagcactcctatgcagaaagtgatggatacagctgttatacggtcggaaagccggggtggcattgtgaagcttcccgagggagatcaggcaaaggatgtgactcgttatacagaccgaatcgtcaaccatatgatttcccatatggtgaaaagagtcagagaagtactgaacaaatatgtttctattaccattaccgacatgacagacttgattccggagctgctctactatatcaaatgggcggagtacattcaaaaattgcaggaacagggctttacctttgctaaagcttctgtatataaagcgggagaaaatgaatctgatccgtatatgatgcaggcacgtggaatttacaatttaaagcttgctgtttttgagacagaggagtccgggaatattgtaccgaatgatatggatttcgaccggaataggagagtgtatatcttaacaggtgccaaccgaggtggaaagacgacaattacacaggctgttgggcagttgtttgtgttggcgcagggtggcatatatattccgggaaaagcatttacattttcccctgttacaggtatttacacccatttcccggcagatgaggacaagacattggatttaggaaggcttggggaagaatgtaagcgttttaaggcaatctatgaggaggctgacagcaggagtctgcttttgatgaatgaatcattttctaccacttcgtttgaagaaggatactacattgccaaggacagtgtcagggcaattttacataagggaatgaggaccatttataatacacatatgcataagctggcatttgatgtggaggaaatgaatgaagaacagcagaaggcagagcacacagatgggaaagcgttttccatgattgtgcacatgaaggggacagagcgctcctatcagattgaagtggcgcctccggaagggaaatcttatgcaagcgagattgcgcagaagtatggggttacatatgagatgctggtgaaataagaaaatgagaagtttgatgtagaactttcagagttggcagaaaagcaatatgataaataagttttgcaaagcatagatatttattggtttatagagtggctggaagtagggtcatcatagaaggtatatatcacgaattacaagattatgaaaattcaatcatgtaaattagggaggacagtgttgagaggacactgtcctttttgttttatctacactatcgctaatcacatatcaaaatccttggctattcccgtcactgacaccacattttttcagcgttattgtattaaatgtaaggaggacatgaattgtgttgacaccctataatatagggtataatatgcaaaaattaaaatgcaaaggataaacttgttgacatgatgtgtgatacacagtatactatgttaaacacatagtgtgcaacacacaatacagtgcaataaacacagtggatttaaataaaggatactgaagggaggagatttgatgaattgtgatgaaattgtttcaggattaattttagaattcagacggggcacactcatcatggtagtgttagcacaactaaataaaccaatgtatggatattcattggtaaaggaattagaaggaaaaggtatttcgatagaaggcaatacattatatcctctactgagaagactagagagtcaaggtctgctaaaaagtgaatgggaaactgaggcaacgaagccaagaaaatattatatcatcacagaagatgggaagctggtttataaaaaaattaaagaacactggaaaaaattttcacagtcaatcaatgttttaatggaggaagaataaatggtaaaaaatgatttgatcgacagatacatttatgcagttacaaaacatatgaaatccgccatgaaaaaagacgtggcggcggaattagagacgatcatacaagatatgttggaggaacgatgtgaggatgttactccaacggagcgtgatatcaaagttgttttaacggaactgggaaccccgaatgagttagcttcgaaatataaaggtgaaacacaggattgtttgattggacagccgtattacagtttatatgtgtatgtattgaaaattgtgacagtgtgcatcagtggaggaatgttacttgcccaaattatggcagcattaacatcgcatacaatctggtatatagctatctatagaaccatcggtgggatttttggcggtatattgacaggatttgcatttgtgacattattatttgcattcttttataaaaaaggaattaaggtggatgggttaaatgatggaatagataatttgcctcctgttccacaaaagtctaataggatttcaaaagtagatgcgattgtaggaattgttttttcggttatcttcactcttgtatttcttgtatgcccacagattttatgcattgcatttgtaaaaaatggggtaggtgtgtatgaaccactttttaatttagaatatatcagacaaacatggtatttcattcttgcatttggaattttgggtgttacaagggacagtgtgagacttattgatggcagctataccaaaagagtgatgcttgttaccattattaccaatattattgatggagtattaacaagcatttggctgttaaatgataggattatgaatagtggattttttgatggtattgagcagttacttggaacggatgcagaaggtatttcacatgtttttatacactataataaggtatttctctcaatcatcattttggcattaacaattaattgcattgagacagtcgtgaaagcagtaaaatacagtcgacaataaaataattttagatgaatcaatctccatttacaaaaatgctacaatgcatatgattttattattgcaacgtattccttacatcacctaacagatgatgagaaaattcaatttattcaattattaaaaacattattaaaagagggtggttgtattctgatcggagatgtggcaagataagatttagaaaaatgtcataaggaaaacaaggatggatgtgataaagaagtaaataaatgttttgtatttaggaggtatggacatgggagacgatgctgaattatattgggaaatggaacataatccttatttttgggatgaagtagaaagctgtagcagaaataattcattcactgaaaataagagtaagaaaaagaagaaaaccattcaaacgaaaagtaatagtacgagaaaaaaggtgaatgcagcgttatttattgatggagaaaatattagttcaaaaaaggcagaacaaattcagaaaattgcaaataaacaaggagtattaggaacagaaaaagtgtatggattgcaaaaagatgagtgtacaaaatcttggtcagataaggcaaaaaaactggatattaaagatattagattgtgtggtaatccagaaaaagataaagttgataataaaataaaaaaagatgtaaaccaagaaataaaaaataataaatcggtcgatgtggtttgcattgcgacatctgacaaaggttatacggatactgttaaagaattaagaagacaaggtaagaaagttgttggaattggtgaaaagaaagctccaaaagaattaagggatgcttgtagtgaattttttgagattaagtaatattacttattggcgttagtagagaaaatcggaagtaatggagggatggcatatataaagatgaattgtgttgacaccctataatatagggtgtaatatagttaaaaagagaagggaaaattacaaatgacaagaacttttattgaggttccgttgttttcaaaaagatggaaagagattggattaggtgaggatgaattacgagcgcttcagataatgttacttaaagatcctgtgtcaggacctataatggaaggaactggtggaattcgcaaggtcagatttccacttcagaatagaggtaaaagtggtagcgtacgagtttgttatactgattttgcggagtatgaagtaatatatctgattacagcattccaaaaaaagagtcaggaaaatcttacagaggaagaaaaaagcgttttaaagaaattagttaaatcgttgagagaggaagctgctaaaaataggaggtgatttttctatgagttcattatttgaggatttaaaagaaggactcgaggaagctatagcttatgagaaaggatatggagcgggtagagtaaaaacatatatgattttgccggtcaaagagtatagtggaaaagaaatacgtgatattaggacaaaggcggggatgactcaaagtgtatttgcttcatatatgggagtttcaattaaaacagtggaagcatgggaaggcggtagaactcatccaacaggaccagtgttcaggcttttagatattctttctaaaaacgaagaaatggaatatattgttgctaaatgagcatagaaatgggtagtagattatctgtctgttttttataacattacatgcagtagaattcttttattatggcatattagtggtagaatggctggtttactttattgttagaagttttaaacaataaatttcagtaatactgagagaagaatttgaggttaatgtattaggtttgaggtaaatgaaatatggaaatcaacaacgatataaatgaaattgtttatatgaaaagagatataaaaagtcataggatttacgaaaaacatcctaatttgatgtttggaataattattcttgtatggggattgttattcttttttggatgtttttcggatgtgtattgggtgtattggatggttttagtgattataattgtcccaattactatttggtatataaaaaacaatgaaaaaacgaatttgactaaatcaagtgcttttattgtacgagatggtatcatttactatattcgccttggatatacgttggattatcaacaatctgggattccattcggattaaaaaaagtagcaattgcggaagaaaatatgaaaaaaacaaaacatattcaagaaattagagaatgtgaaaatacattttcaagagcattgacagaagtattaaattctaacagtctaccaaatggggttgtgaaattttgtcaaatggaggattgtcgattagaaaaagaaacgaagcaatgggtatggttatcgtattataattgttatacacacaatcagagagtaacgcaaaagttcagaaatgtatatgatttttcatttataagaaggtagtttcatgttcattagagtacaaactttaagcttgcaagcttgaatccccttgtccattatatttagttggaaatgagaaacagaatgagaagaatagtagcagctacagaagaaaataaagaagaaattttaaaattgtataagatacagctaggcagggagttttgtccatgggatgattcttatccgggaatgaaggagattgagtttgatcttggtagagaatctttgtttgtaatgattgatgggcaggagattaatgctgatgccggaagcaaagaggacagaattatcgcagcgatttcaattgatgatgatccacaggtggagaggcttgattgctggagccataagctggcacccggggctgagctttcaagacttgcggttcatccggattttcagaatcagaaaatcgctagacaaatgctggtatttgggatggaagaactcgcaaggagaggatacaaaagtgtacattttttagtcaacaagcttaatgtgaaggctctgcgctcgtatgcagtatttggatttgatacagtgggtgaatgtagcctgtttgggcagccgtttttgtgctatgaaaagggtctgtaaaaaaatatgatttttttgaaaaaagtgcttgcatttttgaaaacaatctgatattatatacgagtcgcgtgagacaagcggcgaaaacaaaatacatgcggaagtgtcggaactggcagacgagcaagactaaggatcttgtgattattgcaatcgtgtgggttcaagtcccatcttccgcattgaacaataagacagggaccaagcaaagcgtttggtccctgtcttgttgttcaaagccgaagcgagccttgaacccatggttcaaggtctcgcctccggctcggtcggctcgtggcatgaggtcccccggacctcactcgccccatcttgcgcaagactacggtcgtggtagagcaggccccatgggtccaaggtctccgctccgcttcggtcgttgcagaacagacgtcccccgggcgtcttgcggtctccgctccgcttcggtcggcgcagagcagacatcccccggatgtcttgcgccccatcttccgcaaggcttcggttgttgctgggcaggctctctataatgataagacaggaaaggtaggatttttatgattagatttaataacgattacaaccgcggtgcatttgattgcattttgaaggcaatggcggatacaaatacaaccagctatccgggatatggtgaggatgagtggtgcgataaggctgagcagattattaaggggcttattggcagagatgatttcatgattaaatttattccgggtgcgacacaggcaaattatgttgtggttgcggcggcgctttcaccggtgcagagcgtgattgcagcggatacgggacatatcaattgccacgaggcagcttctattgagaatacaggtcataagattcttgcgcttcctaacacggatggtaaaatcagtgctgcgcagattgaggcgtgtgccgcagagtattatgacaatgcaaagcctgagtatctgacagagccaaagatggtttatatttcatttccgactgagcagggtactctttacacgaaaagagagctttgcgatatcagtgctgtctgcaagaaatacggcatgtacctgtttgttgatggtgcgagaatggggtatggactgggctcagataaaaatgaccttacactttgtgattttgccatgctttcggatgttttttatatcggtggcacaaagtgtggtgcgctctttggcgaagcgctggttataaatgctgaggatatcaagtatcgttttaaggcttatatgaagcaaaacggtgcagtgcttgcaaagggctggctgatgggcttacagtttgccactatgcttgagaatggcgattattttgaaaagacaaagcgtgctgataagcttgccatgcagattaaagaggcatttgaacagaagaaggtaccgttttgggttgagagctttacaaatcagcagtttgtgattttatcggatgagcagaagaagacacttgccgagaaatactattttgaagagatgggaagagagaaggatggcactgtagtacgattctgcaccagctgggccacaaaacaggaggaggttgatgcactggttttagatatatcaaagctggtgtagtaacagatttatagtttttcgtacatttcgtatagttttttaaatttatgcttgcattcttctaaactttttggtagaataatgcttgttcgcaggagtggcggaattggcagacgcgcaggcttcaggtgcctgtggtagcaatatcgtgtgggttcaagtcccatctcctgcattaacagggaagtcggtgaacggcttcctattttattttgtgcagataattttgaaagcctattggctattaatggtctgtaaccgttgcctgccacactgaggggtacagctgtcacaggaatttgattattatattggagatgggattgcagcgtgaagagattgaatctatcttatattaatgtaatatgtgtgtttgttttgtcctttgctgttatggagtatgtaaatcttttgattggcagagtgggtggatttcctgtgcttgcaggggtgcttgtgtcatattccattatgagatatggcagctttgcaaggaaaaatatggcatgctacatgggcatctatatactgacatggtttatcggcacagtagtgctttttatctcaaaatactcaggctggggaaatatcaaaaagcttggtccggcgcagtatttcaaggcactgtacggctcaaccctgtcagagatatggggatatttttttgcaattgtgctcatgctgacagtgattgtttcactttttccgcttactgtgataaaaagcaggaaaatatatgcacggtatgtgttgggaaatacgcttttttggacgataatactcataccgcttaggtttatagataagaaatttgtcaatcacaaggtgatgtggcaggccggctgtatgatggcctttgctgtgcttttgcttgtgctggagcttttcgttgtgtacagactggtgaaatacaggtattgcgatgagcatgcagacaggaaagtgcgcattcacagacgcagggttcgaaggaaaacattaaaagctgtaatagtcattgtgccggtcgttgtcattgcagttattgttgtttacacatatttcatgtcgccttcaaacgagccggctgagtatgaaaaggttgcaagctgtatcacaaatgatgacaggcttgggcctatggtttatgacagtcaggtgtatattccgataaccatagagcttgactatgcagggaccggcagtccgcttggctatattgtatacaaggatcaggactatggcagcaggtactatgagcttgcagcttcaaacctcttatatatgaataagaacggtgacgatacatatttacagatgtcgggcaacgcatcaaattcatacaagaagctgtctgtagttgaaaaaagcaattcatggaaggactgcagcgtttttctcatgtgggatgaggagtggcagtcagagtcgcgctacagcaaggatgtcacaggctatacggagtgcgatgaggatttcataaaaagtcttgaggatacttttggtgcagtgaaaataaatccggcagacttcaagggctatgatgcctattttacaatagagggctacaaatccatgaaggatgccatagagagtgacagtcatgtgggcacctgggtgggctgcatactggcaaaagacgataaattttactatggcagctacgacaatgaaatcacaggcggacagcttcagatgctgcgccatgtgctcggcggtaattgatatagcatttaatttttgccgaaagaaaattaaagtaaaaagaaataaaaaaaggatttttaaaaatcacgtcgaataataactagtgtagagcataattagtgtagagcactgttagtggaatgtaacgctatttgttacatttgtgtgtgaatagcagcagaacataacgactgtgacagcgaggaggcagataaatgactattcgcgagcagatagaaaaacgtgagcaggaaatacttagtccgttcgcatgcctgagcatcaactcaagaggcagggactatgatgagccgcagtgcgatatcagacctgtttttcagcgggacagggaccggatactgcatagcaaggcattcaggcgtctgaaaaataagacacaggtgtttcttacgccaaagggcgaccattaccgcacacgtatgtcgcatacgcttgaggtgtcgcagaatgccaggacaatagccaaggcactgagattgaatgaggatctggtggaggctatagcgctgggacacgacctggggcatacaccgtttggacatgcgggtgagcgcatcctcaatgagatatacgagggtggctttaagcataatgagcagagtgtgcgcatagtggagaagctcgaaaaggacggagcaggactcaatctgacctgggaggtcagagatggtatgctaaatcaccagacctcgctcatgccacacaccttagagggcaaaatagtcaggctttcagacaagatagcctacataaattcagactttgatgatgcaatccgagcacagcttctgtgcgaggatgatataccgcttgagataagaaatacgcttggacacagcaccaaggccaggctcaatcatatggtgcacaatatcatcacaaacagcatgggaaaggacgatatatgcatgtcaaaagagtccgcgcaggcaatgcaggatttgcgtaaattcatgttcgcaaacctctataacaatccagtcgcaaaaagcgaggagaaaaaggccaaggcgatgctcaagcagctttatttctattatatggagcatatagaggagctgccgcagaaatatcttgccatgctagggcagggtgatgacaaggggcgcatcatatgcgactatatatcaggcatgacagaccagtatgccaccacgaagttccacgagtatttcgtaccggtagcctgggaaatagatggatattgattttcgccgggcgacgcaaatgacaacaaagatgaacagtaaggggatgataaaatgccgtactactctgacgagcttgtagaggaggtacgttcgcgaaatgacatagtcgatgtcataggaagctacgtgcaccttcagaaaaagggaagtacttattttggattatgcccattccataacgaaaagaccggatccttttcagtctcaccgaataagcagatgtactattgcttcggctgtggagccggaggcaatgtatttacatttctcatgcagtatgagaactttaccttccctgaggccatgcaggagcttgcagaccgtgtgggaattgagcttcccaagcaggagatgacctcagcacaaaggagggaggcagacaggcgtacacagctgcttgagataaataaagaggctgcgaagtatttttatatgctgcttcgtggaccgagaggacaaagggcgcatgagtatttcaaaaagagagagctgtccgatgagacaatgcagaagttcgggcttggttactcggaccagtacagtgatgatctgtacaagtatctgcgcagcaagggctatgatgatgagatacttaaggagacaggtcttgtgacgatagatgaggtcagaggcgggcacgataagttctggaatcgtgcgatgtttccgattatggatgtgcacaaccgtgtcataggctttggaggccgggtgatgggtgacggagagccaaagtatttaaactctccggagacaaagatatttgataagagccgtaatctttacggacttaatatagcaaggagcacgaggaaaaatcagctccttttgtgtgagggctacatggatgtcatagcactgcatcaggcgggctttgacaatgcggtggcgtcgcttggcacggcgctcacgagcggacatgcctcactattaaagagatacaccaatgaggtgtatctgacatatgacagtgatggcgccggggtaaaggcagcgctgcgtgcgattccgatactcaaggaggtaggcatcacaacaaaggtcattaacatgcggccgtacaaggacccggatgagtttatcaaggcgcttggcgcacaggagtatgaggagcgtatcaaaaaggctgaaaacagctttatgtttcagatacggatcatgcaggcaggctatgatatggacgatcctgagtcaaaaaccgcattttataatgaaatcgcaaagaagctgcttgggtttaccgaggagcttgagcggacaaactatacgcaggcagtgtccagagagtacagcataccatacgacgacttaagaaagctcgtaaacagtatggcaatgaagggcggtatcgtaaagccccagacaaagcttaaaagtggaatcaatgagaaaaataaaaaggaggatggcatgaagcagtcgcagaagcttctcctcacatggctcatagaggataattcactttttgacaggataaaggggcgtatcagtgcagatgactttaccgaagagctgtaccacaaggtggctaaggaggttttttcacagtacgagaccacgcatacagtaaatccggccaggatagtaagcatgtttaccgatgaggacgaacagcgcgaggtggcagggcttttcaatgccacaatccatcaggtggagggcaaaaatgacaaggcaaccgcactcagggaaaccgttgtccgtatcaagcaaaacagcatagactaccgctcaaagcatctggcacctacagatatggagggcatgatgaggattattgaggataagcgtgcactcgaagaattgcaaaaaataccagaataaagaggaaaataaaatggcaaagaaaaaggaacaaaaagacatggcacaggagcaggagcagagactgaatttccagcagaagcttattgagattcttgagcttggaaaaaagaaaaagaatatgctcgaatatcaggaaattgcagattttttcaaggacttaaatctggatccggagaagtttgagatggtaattgattatctcgagcaaaacggcatagacgtgcttaaaatcagcaatgatgatgacgtggatgatgatatcatactcgatgatgaggacgaggtagaggttgaaaagattgatctctcagtaccggagggagtcagcgtcgaggatcctgtccgtatgtatcttaaggaaataggtaaggtacctcttctctcagcagatgaggagattgagctcgctcagaatatggaggacggagcggtagcaaccgagaagattaatgtactaaagggccgcattgatggtgcatcggaagaggaaaaggctgagataaaggaagaaataaagacactgcagagggatgtggacaagggagcagatgccaaaaagcgtcttgcagaagcaaacctgcgtcttgttgtcagcatcgcaaagagatatgtgggaagaggaatgcttttccttgacctgattcaggagggaaacttaggtcttatcaaggcagttgagaagttcgactacaagaagggctacaaattctctacatatgccacatggtggattcgccaggctatcacaagagccatagctgatcaggccagaacaatccgtattcctgtgcatatggttgagacaatcaacaagctcatccgtgtgtcaagacagctccttcaggagcttggcagagagccttcaccggaggaaattgccaaggagatgaacatgccggtagagcgtgtgcgtgagatactcaagatatcgcaggagcctgtttcacttgagactccaatcggtgaggaggaggattcacatcttggtgatttcatcaaggatgataatgtaccggttcctgctgatgcggcagcattcacacttcttaaggagcagcttgaggaggtgcttggcactcttacagagagagagcagaaggtactcacactccgctttggcttagaggacggcagagccagaacacttgaagaagtaggtaaggagttcaacgtcactcgtgagcgtatccgccagattgaggcaaaggcgctaagaaagcttcgtcatccaagcagaagtagaaagcttaaggactacttagagtaagatgattaggctatccagaagaatgaaggcagtggcatcaatggtcacggccggctacacgctgtgtgatgtgggaaccgaccatggctatgtgcctattgccctggtgcagagtaatataataccgaaagcaattgctgttgatataaataagggaccgcttgagcgcgccaatgagcatatacgggcaaacggtctgacagagcagattaccacaaggctttccaatgggcttgaagcgatacacgacggagaggttgactctattgtcatagcaggaatgggaggagagcttgttattcacattttaaccgcaggggagacagtgtgcaggtcggcaaaggagctgattctgcagccacagtcggaagtgagcaaagtccgtgaatatgtaaggaacacaggctataagatagttgatgaggatatgattttggaggacggaaaatactatccgatgttcagatgtgtgccgtgtgcggacaattccgcatgggacaatatggacgagacgacggttactgtatgcgatttgtacggaccggtacttatcaaaaacggtaatccggtgcttcgtaagttccttgtcagggaacaccacaagctggctgccatcatgcagcagctaaggacacaggagatgagtgattccatcatggacagaatcgagcagataaacgagatgatggcatacaatgaggcagcatattcgactatgggggcaataagaaatgcaggaatatagtgtgaaggtgacattgccggatggacaggtcatggcagtgacagcatcagaaagtgatactttagaagccgtagcggacagattcaaggattattatgaggatgacataatccttggaattgtaaacggcaggcttcgtgaactgaataagaaaataaaaagtgactgtgagcttagctttgtgacgacagctgacagggatggcaggcgtacatacagaagaagtgttgtgctgcttttgcagagggctatatacgatgtatatggcagcatgacacagcttcatgtgatgcattcgctcggagaaggctattattgtcagcttgagaaagcagtggagtgtgcggacagccaacaggaaaaatataatgaagatacagaccaaggcagcagagaaaacagtgagaaaagcgtgacagagcatgatatcgacaggatagtctgcagcatgtactcatttgtggaaaaagacctcccaattaccaagcacagtgaaaaaacacagtatgcggagcagcttttcaaggaaaaagggctgcatgataaggagaggctattgcactacaggagaagctccagagtcaatctctatgagttggatggtgtggtggattatttctacggatttatggcaccctcgacaggcatgctcaaatactttgatatagtgccgtatgagagtggctttgtgcttctttttccgggtgctcacagcaggagcgttgagccgcttgtgacatcaaataagctgtttcacacgctggatgattccagggaatggagcaagatgcttggaattggcacgataggctcactaaatgatgcgattgcagcaggcaggggacaggaaatcatgctgcttcaggaggcactgatggagcagaagataggaaaccttgcagcgcagattgcttcggatgacaaaaagaaatttgtcatgatagcaggtccttcatcatcaggcaagacatcgtttgccaacagactgtcaatccagcttatcgcaaagggcagaaagccacatccgttaagtctggatgactactatgtggacagggagctttgcccgaagcatccggacggaagctttgattttgagtgccttgaatctattgatgtaaagctgttcaatgaggatatgaacaggcttcttaaaggagaggctgttgatatgccatccttcaatttcaagacaggaaagagagagtaccgcggaagaaagctggtgcttggccctgatgatatacttgttattgagggtattcacggcttaaatgacaggctttcacagcttatcccgcctgagcacaagttcaaaatctatatctcagcgcttacacagctcaatattgacgagcacaatcctctttccaccacagatgaaagacttatacgacggattgtgcgtgatgcgcgtacacgaggtaccaatgccatggagaccatcgctatgtggtcgtctgtcagaaagggtgaaagggagaatatctttcctttccaggaacaggcggatgtgatgttcaactctgcacttgtgtatgagcttgcggtactcaaggtgtatgcggagccgttgctttttggcatagaaagagactgcccggagtatctcgaggcaaagaggctgcttaagctcttagactactttcttccgatgccggctgacggcataccaaacaattcactgcttcgtgagtttgtaggaggaagctgctttaatgtttaaaactaaaaaatcccgcattccggctgtgtatagaatactgcttgtggcaattgcagtcatggcaattggcgggattgccgtaaattgttatgtgggaaattattatcgggcagactcaattgcggaggctgcaatcgattcagacagagaggtttctgttactattgaaaagaaggacaagcgtatacaggccacccagtacgacttaaagcttaagaattatacgataacctttgcaccgcaggataaggaaaaagccacaaaggcattgattttttatccgggaggcagggtacagtatacggcgtatgcgccgctgatgcatgagcttgcaaagaataatttcgtgtgcatacttgtacatatgccgggcaacctcgcagtattggaccagaatgcagcagacggtatcattgaaaaatacaaggaaatatacccatccatacaggaatggtacatgggaggccactccttaggcggagccatggctgcagaatatgtgtcaaagcatgttgatgagtttgacggactatatctttttgcagcatattctaccgctgacctgtcggattcagatctgagggtttttagcgtgtacggttcagaggatggtgtgcttgatatggacaaataccgcaaataccgctcaaacctgccggaggatacatatgagtatgtcattgatggcgggtgccattcttattttggaagctatggtctgcaaaagggagacggtacacctgatgtggctttcgaggagcagatagagatgacggtagactttattacatacaacagcaaataataattaccggtagactgcatcatatacaacagcaaatgatagttaccgggaaataacaaaatgcaactgagatatctcagttgcatttttaatggtgcaccttgcggcgtacgttactaataagttactttacgaaacgccaataggctttagattattaaaatacgcaggacgataagccgggttatgtcgttgagtgatcatctatctaggacgcctgttgccagacgcctcaagcaacctacctaaagctggcgggccacgtcaaagctttgtttcggtcttgcttcggatggggtttacatgtgccctccctgttaccagtgaggcggtagtctcttacactgccattccacccttaccacaaaagtggcggtatatttctgttgcactgtccttagagtttcctccaccggccgttaaccggcatcctgccctatgaagcccggactttcctcacctgcggtctttcgacacctgcagccgcgatcacctgtcctgcatatttatttaatataccaagcatttttccaaaaatcaagcccttttaccaactttaataaacgaaatataaaatgtttcttaaaagacgataggtctattgacggtttttatcttcaatattatcttaataaatgtaaagaacgatttaaaacctcaaattcatagcgtggacactgtatgaggtaagaatttggctataatgaaaatatagggcgaggcggtaatatgagagaaaaatttatcagatttatgaatggaagaaacgggatggacgagcttgcaagggctgagtcatgtgtagtaatgatattacttgtggtttcaatatttacaaggtcggcgatacttgatatactggctataggactgatgatacatatgtattttcgtgtattttcgagaaatgtaaacaagcgctatgcagagaatcagaagtttttaaatgccaggtatgagtggaccgtaaaggcagagcgcaggaaaaagcgctttgcacagaggaagcagtacaagttcttcaagtgtcctatgtgcaagcaggaggtcagggtgccaagaggacatggcaagatctgtattacctgtccgaagtgccgggagcagttcgtgagacgcagctagtatgtcaatatatatacctgtacataagagcatggagaagagaaatgtttggatatataactgtcaataaggacaccttgtccgaggaaaataaaaaaatatatcaaagctattattgcgggctgtgccagacaatgaagtcgcagtatggcaggcgtgcacagatggcactaaactatgacatgacttttctcatagtgcttctgacaggcttgtatgagccggatagtgtaacgcgggatggatttgtatgcagcgtgcaccctacgaagaagcgtacacttcgcaccaatgagattacagagtatgctgcagccatgaacatcctgcttgcatactacaatctgatagatgactggaaggatgacaagagcctgacgaagaagacatatgcagagatgctgaaaaaggactttgagaaggcaaaaaaaggctatccgatacaggctaaggcgatagaggactacattgcaaggcttgcagagtgcgagaagagcaatgataccaatattgatgcagttgcagggctgacaggagagatgctcggcatactttttgcgtggaagcaggatgagtggcagaaggatttgaaggaatttggctgctatatgggcaaatttatttatataatggatgcgtatgaggatattggggatgatgtgaaaaaaaagtcatataatccacttatacagctcatgcattgctgcaataatgatcaggaaaaatttgacaaatcctgtcggcttatgatgacatctatgctttcagaggcagcaaaaatatttgagaggttgccaattctcttacatgcggatataatcagaaatgttctatactccggtgtgtggagcaagtatgagtatattcagatgaagaaaaggaagaaacataaatgatagatccatatcaggtgctcggtgtcagccgcagtgcaagtgacgatgaaataaaaaaggcctacaggaacttaagcagaaaatatcatcctgatgccaatatcaacaatcctaacaaggatcaggctgaggagaagtttaagcaggtgcagcaggcatatgaccagataatgaaggaaaagcagtccggtgctgccggagccggtggatatggcagtgcaggaagcagcagctcatacggcggcagctcctatggtggagcatatggtggtggaccgggagcaggtgatccatttggagcaggtggaccgtttggtggtttctatggccgctatacctacaataatgcaggcagcagtgcacaggatgacaatccaaaggtgcgtgcagcaggcaatttcatcagcaacggctactacaatgaggcactgaaggtgcttgaggaggtaccttttgctgagagacgtggaaggtggtactactacagtgctatcgcaaaccaaaagctcggcaacacagcgacagccatagaacacatacagcgagcagtgtcgcttgaaccaaacaacatgcagtaccgccagtttatgcagataattgaaaatggtggctcgtggtattcggatatgggagacatatacggacgccctagtggcaggggcagcgagtgctgcagcctgctggccacattcctttgctggcagatgttctgctgctagatgtcaaacttttctgatgttacagatggaaattcatgcaagttattgggctggttatttgaagaacgatggacgggtatattaatctgtgcaattattctgaatagttacctgaaaataaaatgcggtcatgcgaccgcattttttatttatggacataagtaactattcagatccacacatatatgagcaaaatcagctgcgcagcaacggctgtattattccatagaatccggaataccatcatgatccaaatctgccatgtctgctccgtgcgcaccgatatccacagtgtttaaggtgcgtctcttaagtcttgcggcctcagactgcttgagcagatagctctttatctcgcgtgagtgctttacgtgaacgagcttaagctcagggtttgtgacgtcgcctgtgtagcagactatggtgccgagcttaaaaatgcgctccatcagtgatgtggtgagctttacatcagctaccttatacatgtagcagtcatcctctgtggtgcttaagagtccggactctacagtgataaaggacggtgtgacggtatattttgtgaaagtccacggcagaccgagaaacagcagtctctttctctccttaaagattacggcatcgtcatcatcgattgcgccggctgtggtgtttttgatttgtgattcatttacagacatattattctcctttttgatgttaaaattgtcgtaattgtatgaaaacttcaatacaattgctaaacgttcagaacagttatattctgtcatatattctacaacaaaaaagtgtaaaagccaacttgaatattgtgctaagttattatatgatagaaaaaatgtaataaaaattgttacgcgaaaaagaatggaggcaaattatgcgtcacttaatgagtccgttggatttttctgtagaagagttggacaagcttctggatcttgcaaatgatatagaggctcatcctgagaaatatgcacacaagtgcgatggaaagaagcttgcaacctgtttttatgagccaagcacgagaaccaggcttagctttgaggctgctatgcttaatttgggaggctcggtgttaggtttccacagtgctgattcgtcatctgcgtcaaagggagagagcgtttcagatactatcagggttatttcatgctatgcggatatctgtgccatgcgtcatcctaaggagggtgcaccgcttgtggcttcagagaaatcgcgtatccctgtaatcaatgcaggcgatggaggtcatcagcatcctacccagacacttgctgatctccttacaatccgttccatcaagggcagattgaataatatcacaatcggcttttgcggagatttaaagtttggacgtacagtgcattcactgatcaatgcacttatcagatatgacaatgtgaggattgtgcttatctcgcctgaggagcttaaggtgcctgactatgtgcgcgatgatgtgcttcgtgccaacaatatcgagttcaaggaggtagaaaagctcgaggatgccatgggagagcttgatgtgctctacatgacacgtgtccagaaggagcgtttcttcaatgaggaggactatgtgcgtctgaaggatttctacattctgactaaggagaagatggagcttgcaaaggatgatatgattgtacttcatccgctcccacgtgtgaatgagatttctgttgatgtggatgatgacccgagagcatgctatttcaggcaggcacagtatgcggtttacgtgcgtatggcgcttattctgacattacttggattggctgaggactaaaggaggataatatgctgaatattagtggaatacatgagggctttgtgctcgatcatatcaaggcaggtatgagtcttcagatttacagggatttaaagcttgacaagctcgactgcacagttgcaatcataaagaatgcaaagagcagcaagatgggcaagaaggatatcatcaaggtagagtgtccgatagagtcattagatctcgatatccttggatttatcgaccacaatatcactgtaaatgtgataaagggtgacaagattgtggacaagatggagcttaagctgcctcatcaggttaaaaatgtcatcaagtgcaaaaatccaagatgcatcacttcaattgagcaggagcttgaccagattttcgtgctttctgatgagaaaaacgaaatctaccgctgcaagtactgcgaggagaaatacgaaggagttaaatagtatcagttatgtatgccaacgtgattgtggatatatcccacgaaaaactggataagacatttcagtacagcatcccggatgagcttttatgcgacatccgtccgggtgtgtgcgtggatattccatttggcagccgcactatcacaggctatgtgattgaggtcacggataagcctgagtacgacccggcaaggacaaagcctcttatcgggataaaggcagactctgtggctgtggaggcaaagctcatcgcacttgcggcatggatacggcgcaattacggctctaccatgaatcaggcgcttaagactgttatacctgtaaagaagcaggctaaggagcaggtgagccgcagtattgcactgaaaatagacaaggtaaaggcaagggcgcagcttgcgctttgcgaggcaaaaaaacaaaaggcaaaggccaggctttttcgtgcgctgattgatgctgatgatggggcgcgccttgagtattcctttgtgacaggcaagctgtcggtgtcggctgccactataagagcgcttgagcagagcggctttatcgaggtcatcacacagagcggttacagaaatcctgtggagcatatgagtgtggacacctatgataaggtactgaatgccgcgcagcagagtgtggttgatgcgatagaaggcgacattgccgccggtcttagaaatacttatctgattaagggtgtcaccggaagcggcaagacagaggtgtacatggagcttatcgcacactgtatacagtccgggcgtcaggcgattgtgctgattcccgagattgccctcacttaccagaccgtgatgcgtttttttgcaagatttgggaacagggtttcgataatcaattcaagactttcaaatggtgagcgttatgaccagtttgagagagctaagaatggtgatattgacatcatgattggcccgcggtcggcgttgttcacacctttttcaaatttaggacttatcataatagatgaagagcacgagaattcatacaagagcgagtcggtgccacgctatcatgccagggaggtggcgatagagtacgcgcgcatgtccgatgccattgtggtacttggctctgcaacaccgtcggtggatagctattacaaggcaaagacaggcgtttacaggcttttggagctggataagcgtgtggacgacagacctcttccaaagtgtgaggttgtcgatttgaggcaggagcttcgtgagggaaaccgctcgattctttccaccaggcttcaggagcttatggaggagcggcttctaaatggccagcagaccatgctttttttaaatagaaggggcaaatcggcatttatgtcgtgcagagcgtgcggttttgtggtaaaatgtcctcattgcgatgtatcactcagtgaacatagcggcggagtgatggtctgtcactactgcggctacagacagccggtgcctaaggtgtgtccgagctgtggctcgaagtacattagcggctttaaggccggcacacagaagatagaagcgatggtggcaaagcgttttccacaggcgcgtatactgcgcatggattatgacaccacgagggcgaaggatgcgtatgagaagattctgcaggcattttccaatcatgaagccgatatacttatcggtacgcagatgattgtaaaggggcatgatttttcaaatgtcacgctggttggtgtgctggcggcggatatgtcactgcatgtgaatgattttcatgcggcggagcgcacctttgctctgctgacccaggcggcagggcgcgccggcagaggaaagctgcccggcaatgtggttatccagacctacgaccctgaccactatgccatccggactgcaaaagagcaggattatgaggctttttatgataaggagatagagtacaggaggcttatgaactatccgcctgtatggaatatgcttttagtccatgttacatcacctgatgagagtgagtgtggcagcatggcgcagagagtgtacgatatagcagcgcagatgatatcgcatacagatgaaaatcacagcccggatgataggcatcggattcagctcatcggtcctgcggatgcgaccatcgccaaggtaaatgacatataccgcaaggtgatttacatgaagacatctgactatgcggcgctcatttccataaaggatggcatagagcaggctgtgaaagctgatacggcaatgaaaaatgcaaatatctcatttgatttcaatccgatgagtggattttgatagatatagaaggaggcaattatggcacttagaactattagagtggagggagaccctgtacttggcaaggtttgcagagaggttacggaggtgactccaaagatagtaacacttattgatgatatgcttgagactatgtatgaggctaatggtgtaggacttgccgcaccacaggttggcatattaaagaggatcgttgttatcgatgtgggcgagggtccgatcgtgatgattaatcctgaaattattgagtctgacggagagcagaccggcgatgagggctgtctttcagtaccgggaaaggccggacaggtgacccgcccgaattatgtaaaggctcgcttcatgggcgaggatatgaatgagtatgagatagagggagaagagcttttggccagatgtatctgccacgagcttgaccatctcgatggacatctctatgtggagaaggttgagggcgcacttcacgatgtgacatatgaggatacacaggagtaatcattaggatgacatttgttatctgagcttggaaaatatctgggaggcagtaagatgagagtaattttcatgggaacaccggacttttcggtggggacacttgaggcaattatagaggcagggcatgaggtggcactggttgtcacacagcccgacaagccaaagggccgcggcaagataatgcagtatacaccggtcaaggagtgtgcgctttcgcacggtattgaggtattccagccggttaaaataagagagactgctaatatagagtatctcagaaagtttaatgcagatataataattgtggttgcttttggacagattctgtcaaagagtattcttgatatgcctcgatacggctgtatcaatgtgcatgcttcacttttgccaaagtacagaggtgcggctcctatccagtgggctgtgattaacggtgacgagtttacaggtgtcactaccatgaggatggatgagggtgtcgataccggcgatatgattgcaaagagtacagtcagactcgcacctgatgagaccggtggcagcctgtttgataagctctcggcagagggagcaaagctgtgtgtggagaccatgaagatgatagaggatggcacggcagagtatactcctcaaaacagcgaggaggccacacatacatcaatgattagtaaggagcttggctttatcgactggacaaagccggctgttgagattgagaggcttataagggggcttaatccatggccgagcgcatacacccacctgaatggtaagacatttaaggtgtggagtgcaaaggtgattgacggcagcgatgattatgagccgggctgtatttatcatatcggaaaaaatgatatgtatgtacagacaggaaaaggagcattatctttagtagaggtacagctccagggcaagaagcgcatggatacaggttcatttttgagaggctgtcatgtggaagagggctcatttttcacgttatagttattcattataagtaactaaaaacataattaaatgtgagtcaatgttctcaaagatactcaaaatccagagtattcgtttgtgctaacgtcaaagcagtcggaaacgttgagaagtagccagtgcaagttgaaacagtcttgctaattataggatagaaccttgatggtagcgtttagacaatggtagaagcctacgaaaaccaagtagcgaaacataaaatattaagaaaggaaaagctatttagatgaaaacctatatctaatcaatttaaagaatttataggtatgtaccgatggcttagtcgggaatttacgactgtggagtgtacaagaacttgtgagtagcgtattgtttataatcgccaaagcatacacattgaagcagtaactacaaatcgtgagattgtagcgaatcatctagcatatacacatttgtatatgtttttagtagcagagatgatacatgggatattattattgggatccgacatatatactcgttgtgataggtgcagtgatatgtatgattgcatcggcaagagttaaaggtacatttaataaatactcgcagctaagaagcatgtcaggcatgaatggcgcacaggtggctcaaagagtgcttcaggcggcaggcatatatgatgtgcaggtgcgtcatgtgtccggcagtctgacggaccactatgatccgcgcaccaaaacagtgaatttatctgatcctgtgtacaatgccacatcggtcgcagcacttggcgtagcagcccacgagtgtggacacgctatacagcatgcaaaaagctatgcacctctttcaatcaggagtgcgctcgtacctatagccaattttggctccatgcttgcatggccggttatacttatcggcttattatttaacacacgctcgtcagggcttattattgatataggcatattgctgttttcggcagcagtgcttttccagctcgtgacattgccggtagagtttgatgcttcaagacgtgcgcttgtcatgcttcgtacacagggcatacttgcagatgacgagcttaggtacacaagaagggtgctcaagtcagcggcacttacctatgtagccagtgcggcggctgctattttacagctccttcgtatcatacttatcacaaacggacgcaggcgtgacgactgatattgttttagattctgtttgcctgtgattttacagggtggcagttcaaattggatatattagttagaaaattaaatgtatatgtaactattcggaaacatcatcatgataaataatcatagtaaaaataatcataataataaaaatagccaaataaacaaaaataatataccgggcagaccggcaaaatcaaacgtgacagcgcataatgagcactctgtagatacgcgtgagcttgcccttgagatgcttattgagattaatgagcgtggagcattttcacatatcgtgcttcgcagtgtgcttgacaagtatcagtatctgtcaaagcaggacagagcctttatgacgaggcttgttgacggcactatcgagtatatgctgcagctcgactacatcatagactctttttcaaagacaaaggtaaggaagatgaagcccttcatcagaaaccttcttcgcatgagcgtctaccagataaagtacatggacgcggtgccggattcagctgtatgcaatgaggcggtgaagcttgcaaagaggcataagtttgcacaactttcgggctttgtaaacggtgtaatcagaaatattgcaagaaatatagattcagtacagtttgatacattaagcatccaatactccatgccacagtggatagtggacagatttgttgcggcatacggagagaagaaggcagaggagattttcaaggcctttcacagtaagagcaccataagcatcaggacaaacctgaccaggtgtactcaggatgagcttcgtgtaatgcttgaggcagagggtgtgacggtcacagcggttgatgaacttaattatgcgtttgttatatctggatttgattatttgaatggcttgcagagcttcagagacggacttttctatgtgcaggatatcagctccatgcttgttgcacagacggctgctccaaagaagggcgactatgtgatagatgtatgcgcagcaccgggtggcaagagcacccatatagctgagcttttgcagggaagcggccatgtgctcgcacgtgacctgaccgataacaaggtcgatatgattgaggaaaatatagaaaggcatggccttaacaatatgtcggcagaggtgtgggatgccacagtatttgatgctgattcggcgggaaaggcagatatactcatttgtgatctgccgtgctcagggcttggagtgctcggcagaaagaaggatatccgctacaagatgacgcctgagtctgtagatgagcttaccgctcttcaaagacagatacttgataccgtgcatacatacgtgaagccaaacggagtgctcgtgtacagtacatgtacgatagatgaggctgagaatgaggacaatgtgaggtggtttattgaaaagcatccggagtttgagctggataagagctttgctgaaggcaccggaatgaaacagatactgcccggtgagcatggaagtgacggattctttattgcaagattcataaaaagcaaattatgatattaaaataaatcatgaattaataaatataaattggttcgaattagaagaatttgtttatgcagatttaaatgatgaattttaattacgaaaccagatttcaggatataattagtgaagtaataaacaataagcaaaacaaataagaaaaaacatttataaaacaatagttaaatgcagatttaataaaaataatatggaacagataaaagaacaactaactgacatcaaatcaatgaatatggacgagctcacagagtttatcatatcgctcggagaaaagaaattccgtgcgaagcagatatatgagtggattcatgtgaagcatgtggacagctttgatgagatgaccaatatttcaaaaaagttcatacaggtattaaaggacaatgcaatactcatctcgctaaaaaaagaggaggtgcaggtgtcaaagctcgatggcacgagaaaatatctctttgcactcgatgatggcaacgtcatagagagtgtgcttatgaagtacaagcatggaaactctgtatgcatatcttcgcaggttggctgcaggatggggtgcagattctgtgcatccactcttgacggtctcgtcagggggcttaggccgtctgagatgattgaccagatttatcagataggcaaggacataggagagcgcatctcaaatgtagttgtcatgggcacaggtgagccgcttgacaattacgacaatctgctgcgctttatagagcttctcactgatgaaaacggaatcaatatcagccagcgcaatctgacagtttccacatgcggtctcgtaccgcgcatgagacagcttgcagatgaaaagctttctatcacgctggcgctttcactgcatgcctccaaccaggaaaagagaaaagctctcatgccggttgcaaacagctatgatatacatgatgtggtcgatgcatgcaaatattattttgcacagacaggccgcagagtcacctttgagtatagcctggtaggcggagtgaacgatacagccgaggatgcagcagagctttcggctctagtgcatggcatgaattgtcatataaatctgattccggtaaacccgataaaggagcgcgactacgtgcagtccaacaagggtgttatagaggcttttaaaaataggcttgaaaaaaacggaattaatgttactattagaagggaaatgggcagagatatagacggtgcctgtggacagcttcgcaagaagcatatagataaagagagaggaataaactagatgaagacgttttccattacggatgcaggtgctattcgtgagatgaatcaggatttttatttctcgtctgacactgcagtaggaaatcttccgaatcttttcatcgtagcagatggaatgggaggacacaaagccggtgactatgcttccagatacactatagagcgtgtggttgcatcggtatcgagaaatgccggggatgaaccggtatccatcatcaaagaggctatcaacaaggcaaatgagcttttggtggctgagtctcgtgaggatgaagctaagcgtggaatgggtaccaccttagtcgtaggaactattataggaaacaagctttttgtggccaatataggtgacagcaggctttatattgtaggtggcacagagcagatcagacaaattaccagggatcattcactggttgatgagatggtcaggatgggtgagataaatgccgatgaggcgagagttcatccggacaagaatatcatcacgagagctgtcggggcagcagatcatgtggaggcagatttctttgaggtcgagctatgtgaggacgacaggattcttctgtgtacagacggacttaccaatatggtgagagatgaagaaatatgcgatactattaggcaaaatgataatatcgagacagcagcgtcacagcttgtcgccatggccaatgcaaacggtggccgcgataatatcactgtaatgattattaaaccattttaagacgaggtaataacagatgttagagataggaagttttttatcggatcgatatgagatcctaagcaaggttggcgcaggcggcatgtctgatgtatacaaggcaaaagaccatatactgagccgttttgtagctataaaggttttaaagcaggagttttcggaggatagttcatttgtgaccaagttccgtgctgaggcacagtcagcagcaggacttgagcatccaaatatcgtaaatatctatgatgtaggcagcgagaatggtctgtactacattgtcatggagtatgtcgagggtatcacacttaagacttatatcgagaaaaagggccagctgtcattcaaggagtctgcaagtattgcaatccaggtggcaaggggcatagaggccgctcacaataaaaatatcattcaccgtgatatcaagccgcagaatatcattatttctacagatggcaaggtaaaggtgacagactttggaattgcaaaggctacatcttcaaatacaataagctcagatgtgatgggctcagtacactatgcatctccggagcaggcaagaaacggcttcgtcgatggcagaagtgatatttactcactgggaatcgtaatgtttgagatggttacaggccgtgtgccgtttgacggtgataccacagtggcagttgcactgcagcacctacaggaggagattgcaaggccaagcatctacgcaccggatctgccaatcagctttgagaaaatcatcttaaagtgtacacaaaagacaccggaccgcagataccagactattgaggagcttctcacagacataaggcgctctcttgcgcatcctgatgaggatttcgtcacaatagcaccactcgttgacggtggcaagaccaaggttataagcccggaggagcttgacaagataaaagagggcagaggtgtcgcagaggacttaaacgatgatgataccgatgcagataatggtgatgagtatgctgacgatgaagaagatgatgatgaatatgatgagtcactcttagacgacgatgatgacgaagaagacgaagacgatgatgatgacggcaagcttttaaatccaaagatggataaagcaatcacaatcatgggtatagtaacagccgtaatcattgtaatagttatcatatatcttgcactttcagtggcaggagtgtttaagtttggcggcaaaaagaactcagagtcacagcagacagagtcacagacacagaccgagtctgaatcagagtcagagacacagactgagacagagggccagatgattgacatcagaggcatgtcagtggaggatgctcagaaggcagtagaccgcttaaagcttgacctcacagtatttgcatttgagacaaagcagtcagatgcaaaggatggcacaatccttgagcaggatgtcaaggccggagatacagtaaagcgtggttcacagattaatgtagttatcgcaggaaaaggtgatagtacatcagagatggtcaagataccaagcgtaatcggaaagactaagagctcagcaaagagcacactcgagtcagcaggctttagtgtcaccttcgagtatggagattacaatgacagtgtagcagcagatgtagtaacagcacagtcaccatcagcaaagaaacaggccgcaaagggcagcacagtaacagtcaccctctcaccgggacagaagccaatcaccgtgccaaacgtagtaggtgcctcacagtcacatgcagaaagcgccctcgcaggagcagggctcaagtacacctatgccgactcccagtacagcgacacagtacccgccggcagtgtaatcagccagaccaaatccggcgaaaccgtagccgcaggcaccacaatcacacttacactcagtaagggtaagcaggagatatcaactaatgtaagtaaaggaattagttatagtggagaaggaactgtagtaaaagcagagtataagcttgtaggtaaaagtggaactgtatacgataagggttcatatgaaaatacgtcatcatttacagtttccggaacaatgaaagaagctacaggaagtattgtggttacttggacagttcagacaggggaaacagatgaagcaggaaatcctgcaactgtcacacttgatccagtaacgtatagcgtgccataagcataagagacgctaaataattattataaaccggaatagctaaaaagaggtagatattgccattgcgtggggtacaaggaaaacgagcagtagcgtagctacgtcaagttttccacatagcaatagtatttgtatacacactctatagcaaccaccggatagcacccacaaagtgggtgctatccgcaccccactaccacaccaacccgcggacgagaacctgaactcgcggagaggaactaaggaagcggggcaggcatgtgttccgaggaaaaaatatgaaatgccccggggtgccataaacctaccgaggaaaaaacagggcagagcaagccatagcctgtccgtaggagagcccggggctggcttcatattttttaagaggaatatatgcctgcccccgccacccacacaacctcaaagcgcggcatgcaccccgccgaaagcgtgactcctgcaaatacaaaagcacacaaggaaaaccatgacaggaaaaattattaaaggaattgccggcttctactacgtctacgtagaagaaaccaaagaagcaaaagaaactgccacaggcggcactctctacgagtgcaaagcaaaaggcaccttcagaaaacaaaagataaagccgctggttggcgatatcgtcgatatagcagtcctcgatgatgaaaagcacataggcaatgtcgagcgtatactgccacggaaaaacgaacttatcaggccggctgtgtccaatatagacatggccctggttatttttgcatccgcaaagccggatcccaatttcaacctgcttgataggtttttgtgtatgatggagtaccagcatgtcccggttactatatgcttcaacaaaaaggacttaatcacacctaaagagcagcaggagcttaaaagcatatacgagccggctggctatagagtgctttttaccagcacgaaaacaggtgagggcatagatgagataaagcacattttagagggaaggacgaccacggttgcaggtccctcgggagttggcaagtcatctatcatcaactgtctgcaggatgatgtgcagatggagaccggacatataagtgagaaaatagagcgcggaaagcatacgaccagacattctgagattatcccgataaaggatggcacgtatatcatggatacaccgggctttagctcgatggatgtgccgggctttgaaaaggaagatctgtggacatgttatccggagtttgtagagtatgagccatattgcaggtttcagggctgcagtcatataaatgagccggactgcggtgtgaaggaagctcttgcagatgggaaaatatcgcaggtgcggtatgataattataagcttttatatgaggagcttaaaaacagacaaaagtattaatttaaagcataatcaaacggaggaaaacatgaactgtttatcaccatcaattttatcagcggattattcaatactcggagagcagcttaagcagcttgatgaggccggagcacagtatgtgcatatagatgttatggacggcagcttcgttccaagcatatcaataggactgccggtcataaagacaatcagaaagtgcacagagcgtatgtttgatgtgcatctgatgatagatgagccggtcagatatatagatgattttgcgacagcaggagcagatatcatcacagtccatgcggaggcatgtaagcatcttgacaggacaatcgaggcaataaaggaaaagggcatactggcaggtgtagcattaaatccggctactccgctctcagccatagagtatgtgcttcccaaagtggacatggtgcttatcatgactgtaaatccgggctttggaggacaaaagcttattccgtatactgtagacaaggtgcgcgacttaaaggcacttcttgagaaaaccgcaaataaggctgatatcgaggtggacggtggtgttaatcttgagaacgtggagacactgcttgcagcaggagccaatatcattgttgcgggaagtgcggtgtttagcggagatatagaagaaaatgtaaagggttttctgaatatcatgatgtaacagatgcaggttaaaacagaaatgcttccggggctgtagcaaatgtggatatgttatttataagaaggtggataaaatgaggtatttgattgtatgtggtggaaaaatagataaggaattcggcttaaatgagataaagactgacggaatagatgccataattgcggctgacagcggaatggatttcctgtacgaaaacggtgtcacgcctgatataattgtaggtgatttcgattcagccacgacaaaggccttagatttttttgagagaaagggacagacagagatacacaggctcaatcccataaaggatgatactgatacagagtatgctataagactggccataagcgagggtgcacgaagcatagtgctgcttggtgcaacaggcagcagaatagaccatgtgcttggaaatatttcacttttgggtataggactggaaagtaaagctgacatcagcattatcgatacaaacaaccgtataaggatggcagataagcccgtaaccattgaaaaatcagcccagtatggcaggtttgtctctcttatagcagtgacagacgacaatgaggtgagccttagaggctttaagtatcctgttacggattattcctttgacagatctacatcgcttggcatatccaatgaaataattgatgaccatgcagtgattgatatccatagaggaaaatttatcattattgagtcaaaagattgactttttaggaattttgggctattatatttttaggattatttcggaaatttaactacatggaaagatttatcctgtgttagatttagaacgtgatggggttatcagatgatagaaaagtattatagcggggtaattgaacagatttacaatcgcataggaaaagagactcgaaatatcgtaatggcgaattatagcaatgatttttcgattgaaaatcttgaggttataagacgttatcaaagcaatgaggataacgtcttctttgcgtatagtgagttctcttacaatacgctgatcggagcttatgagccatttttggacatcatatgcaatatgcacaggcgctttataggtggaagctttgatgatttccagaaggagtgcggtgtgtactatctgcacagacaggtgttaaacagctattatgagaccggtgagtgtttcagagaggagatggtgctgttaaatgaggtagcatatgagcagagacgcatgacgatggccatagctgatatgcttaaaaggctttcggaagtaaagcctttgatgattgtgataaacagattccagatggcgtctaagagctcaattgagaccatcaagtatctgattgacaatccatgcgccaatatcggtatcgtgttaggtgtcaatgccctggtcaagggtgcagacagcactgttgaggtgtgggatagtatagttgagtcgcttgaggacaggagcgccgtatactatataggcagtgccggacagcttaaaaataccgtaaaaaccacgaatgatgatgagatgtatatcactatgaactttgagcagagcatccaggaagcatcaaatatcatggagtttctggattttgagcaggcaaaaagaggctgccgcatcatagagcataagcttaagtttgaagatgcatggattgatgagaaaagcctgcgccgcttttatatggtctatgcaaggacgtctgttttacttggagagatgtccaaagcgattgagctcacgaatgaattcaaggcgctgataccggaaaatgacagtgagcattatctttcactgtattatttcatgaagggcacctgctatatgtatcagggcaagcttgagaaggctggaaacagtgcaaagagtgcctatgactatgcagttttggcagaggatgacatactgatatttaaggcagagcttttgtcagtcatgataaagatgtcaggctggtacaatatattcttctgtgtacaggatatacctgtcagtgatgaaattatagaaaagctcataaagcacggctacaggaattatctggcacatatatatatttacgcatacgacaatagccgggatgtggtgaagcagtccttttatgatgaatccctgctaaagcattttacgaaagggcttgagcttgcaaaggagataggaaatgagaagcttgtgtatgatgcatatcagaagactatcatgcttgccagcacaagcggtctcaatgagattgcctttttatatgttatccgtacatacgagttcatgaaggggcacggcaatatatatgttgcgagagagctttcgtccataggctacaatttaagtgccatgggtaagaatgagcttgtagatgattattacaacgcggcaatcaatatgttttattacctgaagatgccggaggatatagctgaggtgtattataataagtctcttaactatatcatgcagggcaagtataaggaggctgttcatgcacttcttcttgccatgaagactattataaagcttcatttaaacagcttaagagtgtgcaacacgagtaaggtatatgcgcttcttgcgcttgcatctatattttccggtgacagattcagctgtgagcgctatctgctcagctgcaagcagtttcttaattacgtcatctacagagtaattgacactacaagaactgaggcagtccatgactattccagatgcgatgatgagatgttcctttacttctttgcatcagccatgctcttgtggcacgatggtgaaaaggagaaagcctttttacgttttgaggatgcggatagatatctcgttaatgcggagggaaacgaattttttgcatattcgatatacaggcaaagcaggatgaagctgtttgaacagctcggcagaaatgagcttatagagcatgagagaatactcttagatgctcacaataaaaggatgcatgaaatagcagaggcagctccgcttgacatgttaaaaaatatcaacctggagtcactgagtgatggccatattaatgagcagcagattaatatgcttgtaaagcagcatgggctcgaaaaggattatcagggctcaaagcgtcagatggagtttatttccatatggcagaccattatcgatgtcaatgaccagaagaaggagactatgattgaaaatgccatgagcaatttcgtcaatcatttcagtcttgactgtgcgctgattatagatctgcacgcgaaggcgccaaaagtgctttataatgatacaggctgtgatatgacagatgaggttataaagggcatatgtgatatcatgatagactatccggagggctttgccacatcaaagattggagagggcttctacgagcatgaaaatatcatctcatactttggtgtggacgatgtatgttcatttgtcgcagtgccttttatcaaaaatgatgcgctttcaagtgtgctaatagcatatgtgcgcatgaaggacaattggcatggctccatcgagcgatacatgcttaatgaggatgatctgagcatttttaagctgttgttcagagagcttgagtattccattgcccgtattgaggccaatgagaaggcaaatgagatgaacaagaagctgcagcaggctgcggtcacagacatgctgacaggcatatacaacagagcaggtatgtatcaggagattgaaaagcttgaaaagcgcataagtgtgacatccggtggcatggatgtggggcttatgtttattgacctggataacttcaagcattataatgatacatatggtcatgatgtgggagatctgatacttaaggagatggcctttgtgttcagggaagtagctaaggacagaggctttgtgagcagatatggcggtgatgagtttatcatagttattgagtcatgcgccagatacgagcttgagaatatcgcaaaggatatctatgcaaggattgcagaggcggatggcttcagcaggcagataaagaaatatctcaaccatgacgtagagtttaatgaggagaagaatatcacctgctccatcggtatttcatatgagagaaatgttaccagtgagagtcagattactgagctaattaagaaggcggacgatctgatgtatacagtaaagacaggcgagaaaggacactatgcattcttttaaatctgatgaatttaagataagagtactgacaaaggatgatgcggaggagtacaatgcactgcttcgttatgcttttcaggtgacggaggcagaccttgccgagaccggctggagggatgacgaaatcaagcagtcgaagtttcctgtgcttgagagagctgatgtgctcggctgcttcaatatcattgacaaaagagaagagcttgtggctcagtttgcggtatatccgctcgatatgaatatatacggtgagcgctatgaggtgggctttgtcacaagcgtttgtacgtatcctgagtacaccggtcacggtctcatgaaaaagctcatgagaaagagtcttacgagaatgcgcgatagcaacaagtcgtttgctcttttgtatccatactccatacctctttacagagggcttggctgggagattatctcaaacaagatgacatatgtgataaaggacagacagatccctacaaagcttaaggagccgggctatgtgcgccgtgtgcagtgggatgatgagcagtttaagaagcttcatactcactttgctgcgaagactcacggctgtctgtacagaaacaatctggcttgggaggagtacttccgctgggatgaggacgatacgatggtcgccatctactataacgaggatgatgaaccgtgtggctatatggtgtatcttatcagctccgatgtcatgcacatcaaggagctcatctacttaaaccgtgaggcgcagcttggtctgtgggagtacattcatgcgcacgattccatgattgatgaggtcagaggcaacaactattacagcgagcccatcgcttttgagctcgatgacagtgatataaaggagacaataagaccatacgccatgggcagaatcatcgacgtggcgcagtttatttcacagtataactgtgacccggatggcccgggcggctgctttagctttgagatagcagatgaccttcttccgtggaacaatggcacatttgtcattgattttgagaaagggcactgtgctctcaccgacaaaaatccacagtatcacctaagcatgtctattggcacgtttaccacactgcttttaggctacaagagtgctgagaagcttttgcagatgggcaaaatacagactacgtatgatgctgttgcaaagcttgacgatattttatatcatgagataccatatgtatctgactatatataatgataaaaggtcaaaaggtaaaggaaaataatatgtcaaattatgtgattagctgctgttcaacagcagatcttaccagggagcatatgctcgagagaaatattaagtacgcgtgctttcactatgagctcgacggcaaagagtatatggatgatctgggacagtccatgccactgccggatttctacaaggcaatggaagccggtgccatgacaaagacctcgcagatcaatcaggaggagtacatggagtacttcaggcagttcctggatgagggatatgatgtgcttcactgcgcactaagctccggtatatcaggtacagtcaactcggcaaggcttgcaaaggaggctcttaaggaggaataccctgacagaaagatatatgtgattgattctctggcagcatcgtctggctttggacttttgatggataagcttgctgaccttagggatagtggcatggatattgatacactggctaattggaccatggagcacagacttgaggtgaatcactggttcttctcatcagaccttacattttttatcaggggaggccgtatctcaaagaccgcgggcttcgtgggaaatgtgctgaatatctgccctttcatgaatgtgagcaatgagggaaagcttattgtgcgtgagaaaatccgcaccaaaaagaaggcgataaaggagatgcttgtgaagatgcaggcgctctgcaaggacggtgccgattattcagataaggtatacatatcaaattccgcatgctatgaggatgctagagccgtagctgatctgatagaggctgcttttcctaagatgaagggcaaggtagagataaatgatatcggtacgactataggaagccacaccggtcccggaacagttgcattgtttttctggggcaataagagagaggattagtcagatattttgaccagaatatctgattagaataatcaaaatcaataaagttgattatatttttataaaaaattaaattacatcaaccaaagtgattaaatataatcattccaataactgcgcttatgtgttacaattatatcagttcaaacgaaaagaggttttaagatgaaaggatatgaaaaatacgagcgcagttattttctgcctcctgaatgcacttatgactgggttaagaaggattatatagataaagcaccactgtggtgttcggttgatttacgtgatggcaaccaggctcttatagagccgatgagccttgaggagaagcttgacttctttaagatgcttgtagatataggctttaaggaaatcgaggtaggtttcccggcagcttctgagaccgagttcaatttcacgagagctcttattgagagggatatgattcctgatgatgtcactatacatgtgctgacacaggccagagagcatatcatcaagaagaccttcaaggcacttgagggagcaccgagagcagttgtacatctgtacaattccacatctgttgcacagcgtgagcaggtgtttaagaagtcaaaggaagagataaagcagcttgcagttgacggagctgttttactgagagaccttgcagcagagactgacggtaattttcgtttccagtattcaccggagagcttttcgggcactgaggtggattatgcggttgatgtgtgcaacgcagtgcttgatgtatggcagccaaaggctgataataaggccatcatcaatatccctaccacagtagagaatgctatgccacatgtttttgccacacagatagagtatatcaacaagcacctcaagtacagagacggagtagtgctttgcttacatcctcataatgacagaggctgcggtgttgccacatcagagcttggtgtgcttgcaggagctgaggagatagagggtacgctgtttggaaacggtgagagaacaggaaatgtagatatcgtgacacttgccatgaatctttactcacacggagtggatccacagcttgatttttcaaatctgcctgagatcagggagaagtatgagacatttaccagaatgaaggtaggcgagagacagccatatgcgggagaccttgttttttctgctttttcaggctcacatcaggatgcaatctcaaagggcatggcatggagagaggaaaagaagcttgacaagtggacggttccatatctgcctatagatccaaaggatgtcggcaggacatacgaggctgatgttatccgtatcaacagccagtcaggaaagggcggagtggcatatatccttaagcagagcttcggtatcaatgtgccacagcagatgagagagcaggtcggatacatggtcaagcaggtatcggacgaggagcacaaggagctttcacctgagtgggtacacagtatctttacagacaattatgtggattttcatccatatttcactataccggagtgccactttaagcaggtaaacggcattttcgcagaggcggttattttacacaatgacagcaccagaaaggtagatgccaatggaaatggccgtctcgacgcagtcagcaatataattaagcagtattttgacatcagctttgagctcactgtatacgaggagcatgcgctttcacacggatcttcatcaaaggctatggcatatgtgggtatcacagttgacggcagtatgttctggggcgcaggtgtggatgaggatatcatcaaggcatcaatcggagcgcttgttgttgcggtaaaccattatcttgccaccaaggctgacagtcacgtgaaggatgagcgctatattgccatgctcaacttcatccaggccaactacaagacggtatcgcttgcagatatggctgcacagttcaatctgacagagccatatatctccaagtacataaaggagaagtcaggcaagaccttcggagagctggtcaccaatgccaagatgaagaaggcacgtacactgctgagaaacagcatcacaactgttgagaatatcgcaatcgaggcaggatatcagaacgtggagcattttaacagacagttcaagaagctgtatggaatgacaccgcttgagtacagaaattcaagcacaaaataagcggatacagcattttaatataaccggatcaatatgctaaatgacaattcattcagctgtattggtccggtttgctttttattactgcactttttatgtaaaaatctgcattaaaattgtataaaaatgggaacaatgggctattgattgtattttatcaagtaatttgttgtttttacaacggattatatgtacaatgcgggtataatataaataaaagataattattcagaactactgataacaaagcagatattgagaatttgtgtttgggatgaatagttataataaaaagcaactatttgaattatagtttaagaaagagaggaacgtacatgagcaataaaactagcgcagttgttaagacaaacccaagaaaggctgtaatgatcggatgtggattcgttggttcggcatcagtttttgcacttatgcagagcggtcttttttctgagatagttctcattgacgctgataaggacaaggctgagggagaggcgatggatataagccacggtattccttttgccagacctatgaagatatatgcaggtggttatgatgatgtggcagatgctgctatcattgttgtttctgcaggtgcaggccaaaagccgggcgagacaagacttgatctggtaaataaaaatgttgcaatcttcaagagcatcattccggagattgcaaagagaaatttcggtggaatcttacttatcgttgcaaatcctgtagatattttaacacaggtggcacagaagctttcaggacttcctgaggagcgtgtcatcggttcaggtaccgtgcttgacagtgcaagacttaagtacgcgcttggagagcaccttgaggtggacagccgaagcgtacatgcatttatagtaggtgagcatggagacagtgaggtggttgcatggtcatcagccaatgtttccggagtggagcttcacaagatgtgcgagatgagaggtcactacaagcacaaggagaatacagaggaaatcgctgcaaacgtaaagaacagtgcttacgagataattaacagaaagcatgcgacatattatggtatcgctatgtcggtcagacgtatctgcgaggtaatcatgcgcgatgagaagtctattcttcctgtttcacacatgatgcacggacagtacggcatcgacggtgtggttctctcaatgcctgcaatcgttggagcaaacggagtggagagcgatatcccaatcgagttaaacggtgaggaagctttaaagctcaaggagtctgctgatgcacttaagagcatacttgacgggcttgagctgtaaatatcatgctcttaatattaaacttatataaaatactataaattcagtagggtttggggtataatgataactgtcgggctgcatatattatgtgctcggcggttatttgattttatggcagataattatttagaattaccgggaaaaaggagtatatataatgagcgaaagaaaacaaatccatcaggagtttctgacaggcgaaagagccctgtttgcaagcaacgacctggatatatatgatacaatttttgatgacggagagtcacctcttaaggagagccatggcattagcctgacaggctgtttttttagatggaaatatccgctatggtactgtagtgacatagctgtaaaggactgtacatggtttgacatggcgcgtgcgggtgtctggtatacagacaatatctctgttactgattcaatagttgaggcacctaagaacttcaggcgatgcaataacctaaaacttaaaaatgtgacatttccaaatgcccaggagacactctggggttgtgatcatgtcgatatcgagaatgtctcggcaaagggagattattttggcatgaatacaaataatcttatcatgaagaatttccagctggtcggcaactattcgtttgacggttcaaggaatgtagaggtgcacgattcaaagcttatctcaaaggatgccttctggaatacggaaaatgtcacagtctatgattcatttattacaggtgaataccttggctggaacgcaaagaatctgacacttataaactgcacaatcgagagcttgcaggggctttgctacatcgacaaccttgttatgaaaaactgtaagctcataaacactacattggcatttgagtattcttcggtagatgcagagatttgcagtaaggtggacagtgttttaaatccgacaagcggagtgataagggcaaaggagattggcacactgactatcgaaaaggacagagttgacccatcaaagactaagataatatgtgagggaaaataatctatgtatgattttgacaccgttgtagacagaagaaatacaggctcactaaagtgggatgtggcagaaaatgagctcccgatgtgggtagcagatatggattttaagacagcgccccagataatagatgcaatatcagagcgtgtttctcacggagtgtttggctattccatcattccggatgagtggaatgatgcgtatatttcgtggtgggacagacgccatgggcttaaaatcgaaagagacagcctgattttttgcacaggggtcgtaccggccatatcatctacagtgcgaaagctcacaacacccggtgaaaatgtgcttatcatgacaccggtatacaatatattttttaattccatatttaataacggcgtaaatgtgcaggaaagcccgcttggatacgaaaacggcagatattttgtggactatgacaggttggagcatgacctttccaatccacagacctcgcttatgatattttgcaaccctcacaatccgtgcggtatcatctggacaaaggatgagcttgcgaaaataggtgcactctgcaggaagtacaatgtgacggtcatatcagacgagatacactgcgacatcacagcaccgggaaaatcatacgtgccgtttgcggcagcatcagaggactgcgctgatataagcatcacctgtattgctccgaccaagtgctttaatatggcaggcttacagactgcggcagtgatggtgccaaataaatttttgcgccacaaagtatggcgcgcattaaatacagacgaggtggcggagccaaacgcatttgccatcacggcagcagttgcggcattcacaaagggtgagccgtggcttgaggagctcagaaaatatctctgggaaaaccgcaaaacagtctgtgacttcatggcagaaaacctgccgcagatacatgtagtggatgccgatgcgacatacctcatgtggcttgactgcagtgcactcacagatgattctgtggcatttacgcagatgattcgtgaaaagacaggcctttatctgtcggagggagctgagtttggaggcaatggccgttactttgtgcgattgaacattgcatgccccggttcagtgcttatggaagggttggaaaggttaaaaagagctctcgtttaagctgaatatgtacattttttaaaataaataagaccggtgatcggccggtcttatctggtataattaaacatttatggcatacaagatttagaaatatatcatgcatacgtttgttttctgattcgatagttagtatacactaacatgaattagaagtcaataacaaatatggggttttgatatttttttagatttttataaatcacgtacaaatcaaaagaaaagttttgcaaacaataaaatgtatgttataataaaataactgaattaaaacgaacgaaaataaactcacgggggtattcgaaatgcgaaacaatgaatcatcagaaaactatttagagaccatacttattctcagcaagaagcttcctgtggtacgctcagttgatatagcaaatgagcttggatttaagaaatccagcgtgagtatagccatgaaaaatcttagggaaaagaacaatatcacagttagtgatgcaggctttatcacactcacagagtcaggaagacagatagcagagatgatatacgaaagacatgagcttttgtcagagtgtcttgagaagcttggtgttgataaggagattgcagcagaggacgcatgccgtatagagcatgtcatcagtcctgagagctttgaagcaatcaagaagtatatacataagggctagtacatttattgaaatgaaacagttgtttgttacatattggtgtggcagataagctgacggatgagaccggtaccgcagggtgccggtctttttgtgtatcgttttgcttgtatatatgagaaaaataatctataatagtggagctgtaatcggcgacatcaaatctgaaaggggaaaagatgaaacagatattaaagtatttgaaggagtacaaaaaggaatgtatctgtgctccgctatttaagctgctggaagcatcctttgagcttatagtaccgcttgtcatggcggcaatcattgataacggaattacggcttcggacaagctatatatatggaagatgggaggtgtgctggtgctgcttgcggcagttggtctggtaagttcggtcacagcacagtattttgcggcaaaggcggcagtcggtttttccacaaagcttcgccatatattgtttgaaaagatagagtcactgtcattctcaaagatggatacagtgggcacatcgacacttatcacgaggatgacaagcgatataaaccaggtgcagtcaggagtcaatctggtgcttcgactcttccttcgctcgccatttattgtattcggagctatggcgatggcttttacagtaaatgtaagagcggcaatggtttttgcagttaccatacctctgctttcaatagtggtattctcagttatggctgcaagccttccgctttacaaaaaggtgcagagctctcttgacacagtgctttcacataccagggagaatttagagggaaccagagttataagagctttcaataagcaaaatgatgagattgacagcttcaacagggacaacgagtttttaaccaatatgcagcaggttgtaggacgaatctcagcactcaccaatcctctgacctttatcattataaatatcgcaacaatcgcagttatcgtatcaggcggcaagcaggtatacgcaggaatcctcacacagggtgaggttgtggcacttgtaaactacatgtcacagatacttgtcgagctgataaagcttgcaaatctcatcgtacaggtgacaaaggcagtggcgtgcggtaatcgtatagcggatgtgctttctattccatcaaagcttcctgagaaaaatcctaagctcattgatgcaaaggcaggggcacctgaggttgagtttgaccatgtctgcatgacctatgagggagcggccgatgagacactcacagatataagctttacagtgcaaaaggggcagacaatcggaatcatcggtggtacaggttcaggaaaatctagccttgtaaaccttatcccgaggttttatgatgccacaaagggtactataaggattcagggaaatgatataaatgactacgatgcagtgcagcttcgagacaaaatcggtgttgtaatgcaaaaggcagtgctttttgcaggaacgatagccgacaacctgcgctggggcaaaaatgatgccacagaggaggaaatgtggaaggcgctcgatatagcacaggcgacagaggttgtaaagggcaaagagggaggccttgactacatgatagagcagggcggcaagaacttatcaggcggtcagaagcagcgtcttacaattgccagagcggttgtaaaggatcctgacatactgatacttgacgacagtgcatcggcacttgattttgctacagatgcgagtcttcgcgcggcattaaagggcatgcatggtgacaagacaatatttatcgtgtcacagcgtacctcatctatccagtttgcggacaatatcatagtgctcgacgacggacagatggttggcttcggacctcatgaaaagctgcttgagacatgcgagacctacaaagagatatatgattcacagtttaaaaaagagtcggatatgaccagacaaaaggaggtgtagagtatggctatggataatgcgaagatgaataaagcaggcacaatccgcaaggtattaagctacatgaagagatatattcctttgcttgtaatttcacttgccctgtctgttgttacagtggcgcttacgctctattttccaattctcacaggacgcgcaattgatttgattgtaggaaaaggaaaggttgattttacggctatgacagccatcctcacgagagcagcaataatagtcgtcatagcggcagcagcccagtggcttacaaatatctgcaacaacaggatgacctacaacatagtgagggatataaggcgtgatgcatttttaaacattgaaaaaatgccactttcctatattgacagccactcacacggtgatatggtcagccgtatcatcgccgatgtagatacattttcagagggacttttgatgggcttcacacagctctttacaggaatcgcaacaatagcaggtacgcttattttcatgctcacaatagatgtgaagatatcatgtattgtagtgctcatcacacctttgtcactttttgtggcaagctttatcactaaaaagacttattccatgttccagctacagacaagaacaaggggagagcagacatcactcatcgatgagatagtaggaaatgaaaaggtcgtacaggccttcaaccatgaggatgaagcgcttgaacagtttgacgagataaatgacagattacagaaatgctcactgagggcaacatttttctcaagtcttacaaatccgtgtacacgctttgtcaacagtcttgtgtatgccggagtcggaatttttggcgccatgagtgcactcaccggcggaatcacagtaggacagctttcatgcttcttatcatacgcaaaccagtacaccaagccgttcaacgagatatcgggtgtcatcacagagcttcagaacgcacttgcctgtgctgctcgtatcttcgagctgattgaggagaaaaaggagatacctgatgcttcggatgcggtaatacttgaagatgctgacggccgtgtggacatagaggatgtttatttctcatatgtgccggataaaaagcttatcgaggatttcaatctccatgtaaagcctggacagcgcgtggctatcgtaggaccgacaggctgtggaaagacgacaattatcaatctgcttatgaggttttacgatgtaaacagtggaacaattaaggtgagcggacacgatatcagaaaaatcacacgagagagtcttcgtgacaactatggtatggtgcttcaggagacatggctcaagaagggtacaatccgtgacaatatcataatgggaaagcctgatgctacagatgaggaaatcattgcagcagcaaaggcatcccatgcacacagctttatcagacgtctgccgaagggctacgacactgaaatcggtgaggacggcggcagcctgtcacaggggcagaagcagcttttatgcatcacaagagtcatgctctgcttacctcctatgctgatattggatgaggcaacatcatcgattgatacacgtacagagattaagattcagaaggcatttcttaccatgatgcagggcaggacaagctttatagtggctcatcgtctgtctaccataagggaagcggatattatccttgttatgaaagatggaaagattatagagcagggcaatcatgagagcttgcttgcagcggatggattttatgcaaatctctacaatagccagtttgcatagcatagaggctatataaggacatataaatacggggcgtaagccgccggagtgactgccatacagcataggcactctctcgttcgctacgctactctgccaagatactgtacgaattatgcttttagggcttctatgcccgacaaaaccgtcgaaacgcgccgtccctggcgcggttctccttgagctcccatccgtgggagctcatttttatgtatcgtgtgcataattctacagtatctaggcagctacgctatgcgcttacgaaagagcgcctatgctgtatggcagtcactccggcgacttacgccccttacgttgtggctgaaagctttttgtgttgaaaatttaatattggcaagtcacgtaacatacttttttgtaaaaggagtagtggaaaatacttcaatgtaagcagattttaacacactttcagatggaataatcgcatgaatatagcgaaagagtaagggaaggcgaccagcgcatggggattggcccgcccggcagaggggctcccgagagagcgactagcgcagcggcttagatactgtagaattatgcccatgaaacgcagaaatgccccggcatggacgccggggcaaggagaaaccgcgccatggacggcgcgtttcgacggtttcgtcaagtatagaaaccctaaaaagcataattcgtacagtatcttagctgcgtagcgttagctcgtcgggagcacctctgccgggcgggccaatccccatgcgccggtcgccttcccgtattattaaaagatacgaagcaattcacacttactgcgcagcatcaggagctacatacgagtatgcattggacatctttgcagcattgtttgtcagagtgacagcctctctgtagtaggcaacaacaggagtacccttatccacagcgttgaacagctgctctgcaaaagcaggcggcacattgatacatccgtgtgagccggaggttttgtaaattgttcctccgaaggtatcacgccagctggcatcatggatacctatattgtaggcaaacggcataaaatagctgacaggagaagagtatccctcgccgacaagagtagcatttctctgcttgtaaacaatcttgtatacaccgtctacagagccattctgacgggcgagattacctgatacgaaatcagactccatctggagagcaccatccttgtaataccacatgtgctgctttgtgtagtcaatctctatgtatgtattacctatgtcgtcagcgcctcggtagagtgctgtctgctcgtaaacaggctctctttccactggcttgcctccatctaaatctgaaaggagctgggctttctcttttttcttgctgactacccatccgtagtctccaccacctatttcaatagtgtcaccggacgatgtcttgaatgagcgtttgcggccgaaggtgttgtatttggaagcaagctgctggacatatttagtgaccttggcatcatctatgctcacgctgccgtcatctgagatgcttagcatatcaaggattttggctgagtcaagcttctcgtcggcaccttcaattttgtaggtgacggttgaagcagtgtatttgtcgagggcttctttttcatttttgatagtatcactgttttttgtgatttttggagcttcataacagtcatcacttaaggtaagctttggaagctcattgtccagggcgtcctttacttcggcaaggatgctgtcatatatcggcttgcagccttttttctcttcaatcacattgtattcgccgtcttttatctcgatatgggcatcctccggattttcaatgtagtcatcactgaaaatatcaagagccttgagcttttcagccaaagtggcatcgtcatatttggacgaaccctttagagtatagttttgagctttgaagagactgacaggccatgtaaaagcattctggctttttaggatttgttcctcgtcaccgtttgagacatattcataggaaaaatcaggtcccttaagtgaaaagctgttgccttttctgtcagtgattgtgagcagatagtcgcggcttagggctgtatttttttctaatgcttcttttgcagttttccctgcgtattttacagagttaatctttgtgttgaacagatagtggctgctaaaataaaaggcaaagccaagataaacagccaaaagcacaccaagcacaacggcgcaggttataagcacttttttcttcatgtaaatcgacctccttggagatatgctgttgctgcccacaccgggggtgtaggcggcagctaaaatcagttacatttgtgaagatgtgacacatccatatagtcaggcagaccattcttgtaggctacagcggtttctccctgaataagtggctttaagtattcgataagctcaggtttcacatcattgccagcatcattgatccactctcttggcacagacttggcctcgtttgcgatatccttgatagcagaatatgtgtatttcacctgataaggattatttgagatgcgctttaagcataccattgatgcggtcacaccctctgctgcaatagtgacaccctttttaccctgagcaaaagattcctcgatatcggttaatgatgcaaggtgtgaggcacagcgctggagcacatttacctctacagagcgcaccttgacaccgatgttttcctttacgatgaactcaagagcttttccggcaccgcttagctgctggtgtccgaactggtcacatgcggcctttgatgatgtaatgtatgagccgtctgcgtcatgtattccttcggatacggcaactattacattgttagtgtgcgcaagggcttcttttatatcggcaacaaatttgtccttgtcgaaatccacctcaggcagatatatgaactgaggcgctgtattgtactcattacgtgcgagagcggaagcggcagtgagccatcctgcgtcacgtcccatgatttcaacgattgtcacactcttaacagcatagataaaggtatcatgggctatctcgagcatgcttgatgcgatatatttggcggcagagccaaatcccggagtgtggtctgtcatgcacagatcattgtcgatggtctttggaatccctataattttcacatcactgttgattttttttgcataatcggataactttaatacggtatccatcgaatcatttccaccgatgtaaaagaaagcttttatagaaagcttatcgaactggtggaagatgtatacatatggtgaatcatcatccttgtaatcagggagcttgtggcggcatgagccaagatacatggcaggtgtggtcttaagcttttcaagattagcatcatctgcaaaaatatctgacagattgagataattctcatttaatatgccgagtattccgtttacggcgccatagcagatatcgtatttctcagagctttttactcctgcgatgactcctgcaaggcttgcgttgattgcaacagttgggccgcctgactgggcgacgatacagtttgactgattcattgtaatctccttattgtgtattttaactattctcttctgtaagaatagttatgatataatttgaaaatgactactgaaggcgcatggcatatgcaccgcataatcatatagattgtagtatcaaacattatttttagcaagggttaaaatgaaaaatatgaataaatacgagaattgcttattgtgtccaagaaaatgtggcataaacagaagcaccggacaaacaggcgtatgtggcgtttcatctgaaataaaggtggcgcgagcagcacttcattattgggaggaaccatgcatatcaggaaaaagaggaagcggggcagtttttttctcaggctgcagcctgcactgcgtgttctgccagaacagggagatttctgacggaaaagagggaaaggtaatcagtaaagagaggctgagtgatatctttatggaacttgctgacaaaggcgcaaataatatcaatctggtcacaccggggcagtatatccctgatatagtgtgggcggtaaacgatgcaaaaagccgcggcatgaagcttcctattatatacaatacgagcggatatgaaaatgtgacagagctaaagctgcttgagggcatagtggatgtgtatcttccggattttaaatatatggacagtacgctttcggcaaggtattcaagggcaaaagattatccgtctgtcgcaaagcaggcgctttcagagatggtcaggcagcagccggatgtcgtgattgacaatgcgacaggactcatacaaaagggagttattgtgcgacagcttctactgccgggacatgtgaatgatgcaaaggctgtacttaagtacctgtatgatacatatcatgatcacgtatatataagcatgatgagccagtttacgccgattgcactaaaggattatcctgagataaaccgcacagtgacaaggagagagtatgaaaggcttgttgactatgccctcgaaataggaatcacgaatgcatttatacaggagggtgacgtggcaaaggacagcttcattccggcatttgactgtgagggagtataatatttaccgtttttcttaataaaatagtaagaattggcaggcaaaaatgactggattttgtgacgccggtgtagtactatggttatgtgatattttttagctgtgaaggtactgaacagttacgatattttgttattactcacatcccggtgtgacagacgataatgtttttaatcacacaggatacatcattcaatagaggatacagtgatgaaaaatatagaagaacagcagataataattgaatgtccgaatactatctttcatctatacattgacagtgaggatgagctttcaaaggttaaggtgtttatgaacaatatgaagaatgttgattcgataagtctgcatgatatatacaactggtgcaacagacagcatgtgcagtacacgacgacatttaattatgacagtaaaatgaccttgacagaaatgataaaatcctacatattttacttcagacagaagcttagatatgtaaataatagtgataggatgatagaaacatgagataccctgaatttctaaaggatagaggaacaataggctttgtggcgccttcgatgggctgtacaacagagccgtacaggagtgcctttgacaatgccattaaaaggtttcacagcatgggttataagacgatagagggacctaactgcaggtgcgacagtggcataggtatcagcaatacacctaagaagtgcgcagaagagctgaacgagagctatgcttctgctgacagtgatgtgcttatatcctgtggtggtggcgagctgatgtgcgaggtagtgccttatattgattttgagcgcgtgaagcaatcaaagccgaaatggtacatgggctattccgacaacacgaatttcacatttttggaggctactattgcagatacagcaggtatttacggaccgtgtgcgggcagctttggcatggaggtgtggcatgagtcacttaccgatgcgtttgatctgctttgtggcaggaagctttcatttaccaattaccctatgtgggagaaggaatcgataaaggatgagaatgctccgtttgtgggctacaacctgactgaaaagtcgtgcatcagctctattcccacggtggcaaaggaaagcaggcttaccattagaggcaggctgcttggtggctgcatggattgtcttatcaatctgcttggtacatcgtttgaccatgtaagggaatttaatgagcgctacagtaatgatggtatcatatggttccttgaggcctgtgaccttaatgtgatgggcatgagaagggctatgtggcagatgaaaaatgcaggatggttttcaaatgtaaagggctttcttatcggacgcccggcgcacttcggagaggaaatgtttggcatagaccacagacaggcgctttcatcactgcttagagagtttaatgtgccaatcatcatggatctggatataggtcatatgtcaccgatgatgcctgtggtatgcggaagcatggcagatgtcagcttcgacggaagcaactttacaatttcgtatgatatagagcagtagattggaggaaaaatgattagattaataaagaaaaaagcaaagagtattgtatgtagcgtgcttgctgcggttacactgtttacgatgaatccggcagtatttgcaacagagacagctacgcagactgatacagtttcaagcgttgatgtatcaggcagtgacagcagtgacgcagctgataagagtaacacagacagtaatgcagacagcacaacgacagccggcagtgaggcaaacgacaaggtgaccatcagcaaaaatgataagccatacttaagtcttggagcagacctcacaccggatcagagagcgacagtgcttggatttatgggaatcgagctcactgatctggacaattacgatgtggtctatgtaaataatgatgaggagcacaagtacctcgattcatacatcagcaagagcgagattggcacaaggtcactttcctcagtactcattacagaggataaaaagggtgcgggtcttagtgtttccacgcacaatatcaattactgtacggtaggaatgtacaagaatgcgcttgccacagcaggcatagctgatgctaaaatcatagtcgcaggacctttccctatttccggaacggcagcacttgtaggcacactaaaggcatacgaggagatgacaggcaagaagcttgacgacaaggtgacagacgcagcgatggatgagcttgtcacaacaggagagctcaacaagagcattgacggcgattcgcaggatatcgaggcaatgattgcagacctaaagaagcagcttgccgatggaaggctcaaggatgagagccagataaaggatgcgataaaggaggctgcaaaggattacgacctgaagctttctgatgatgatattgcaaagcttacatctcttttaatgaagctaaaggatgccaatatcgactgggattcagtcatcaaccaggcacaggactgggcatcaaagcttggcgataagataaatgacccgggcttctgggaaaagcttggtaactttttcatggatttatgggataagataaaatcactgttcagctagaaaaagctacaggagacagtaagaataagcagaatatgaatcaggcaactccctgaaacgtaagcattagctgcacgttgaagggagtttttttatcattaataaaaaaataataaatttctgccgaatacattgatacaaaggtcatattctattataattaaatggataatggattaatgtaaacaatgcacataagaaagatgggatttgatgataaagataaataaatttctggcagcctctgtcgttacattgtcattagccgcatgtgacctggcaccatacagcagcatagcagtctatgcggatcaggcggctaaggttgtgtgtgatgagagatactgggtagcggcgagaagcggaccgggcacagagtatgagctggagcacaagctttcaaacggcaaggatattactattcttgagcagaccacaggtgcagacggcaaggtgtggtacaaggcaaagtacaatctggcagcaaataatgaggagtgtgtcagctatatcaggtctgattttgtatcagcaggtaccggcacagctgtatcagacaatgcgcagacaggggatgcttcggcagacaccggcaatgcggatgccatacagcagaataatgaggagcagcttgcccttgcaaccgcatcgggagcatatgctacaggtacgattacaggtggcaatgtgtatgtccgcaatgcagcaggcacatccggcactaccaaggttgtctcactcaactggaaccatcaggttgacataattggagagaccagggtaaacggtgtggtctggtataatgtcaagggtactttaaacggcaaggcatttacgggctggactatcagtacatacataaaggtgacatacaataatagcggagacaatactgattttgtcacggctatgaagaatgcaggctttccagacagctatattccaaacctcacagcacttcacaataagtatccaagctggacctttgaggctgtaaatacaggactgaattgggatacggtgattgaaaatgagagtagaaatggattaaatgttgtttctaagacagcagatgattccaaaaagtctactgcagttggagcatatgattgggctacaaacaagtggacggagtatgaaaaaggctgggtatcagctaatagtgcatatatagcatatattatggatccgagaaatttccttgatgaaacgaatatatttcaattccaaagcttggcatattcagctaatgataatttatcaggagtaaatgcgattctaaaaggaacatttatggaaggaacaaaaaaatattccacggaatctattaattatgcgaacacttttttagatgtagctaaaaatacaggtgtaagtgcatatcatttagcatcacgagttaagcaagaacaaggaacaaagggaactagtccgcttatttcaggaacatattccggatatgaaggatattataatttcttcaattttaatgcttatggaaaaacaaaggaagatatatacaaaaatggtttgtattttgctaaacaacagggatggaatactagagtaaagtcaattcagggaggagctgaaaagcttggtaaaaattatattaataaaggtcaaaacacgttatattttgaaaaatttaatgttgtaaacaattgtccatattattcacatcaatatatgacaaatgttacagcagcacttacggaaggacaaagtgttgctaagggatactctgataaaaatcaagcttttacatttagaataccagtatacgataacatgccttcatcagcggttgggtttaataaagcgggcgatacgaataattatttgcagtcgctttctattagcggagttacgttaactccatcatttaatggagctacaacaagttattcagcagttgtttctaactcaataagttctgttgttgtttccgctaatcctgtatcagctaatagtggaataacaggcacaggtagttattcgcttactgttgggaataatgtaatcaaggttaactgtaagtcacaaagtggtgacacaagaacttatactattaatatatatagacaggcatcagcaaataatacaaacgataataacaatacaattaattcatctgttagtatctcatcgtctaagtataaaatggatacatatgttactggcgtagaacctaatgttagttcagatgtaattaagaagaatatttctgtttctgcaggttcgattaaaattttaaacagttcgggtgtagaaaataatggaattgttggtactggaaataaaatagcagtatatgattcaaatggaaacttggtaaaaacagttgatattgttatatatggtgatgtaaatggtgacggaaaagtgaccatcaaagatataatgcttacaaatagaaatattcttaaaaaaatatcattaaatggaggatatttggaggctgcagatgtaaataaagatggaaaagtaactataaaggatattatgctaatcaataattcgattttaggtaaatcaaaattaacacaataggagtaattaatagagatgagaagaattcgtagtattattataacaatgatgttgattttaacgacgacgttatttagtagagtaccggtactggcggcggctaatattagtgtttcagtaaataagtcgaatgttaaagttggtgatactgtaacagttacgttgtcgattacaagcggatatggagctcagggagttttaaaaaaaagttcaggagtgcttggcggaagcagtgatgagtattttacaattggagctggtgtaggtgatgttcagagtttttcgtataaggcaacatctgtaggtacatgtactttttcgatacaagaaccattggatgatactacagatgtggatggtggaaccccgagtattggagttggttctgcgacagtgaccgtaacaagtgcttcatcaaacaacgattcaaacagcaacaaggataacaaggataacaaggacaattcaggcagcaatacaggtaatgacagcgatgcaaataaagataatgaaaacaaagaggaaaagaaatcctcaaacgcatctcttggctcacttgttatttcagcaggtacactttcacctgagttttctgctgcgacaaaggattacacagctacagtagattacagctgttcaagtcttgcggttacagcaaatccggctgattccaaggcgagtgtgacatctgtcacaggcaatgattcgcttgaggttggagagaatacagtaagcgttgttgtgacagcagaggacggcagcacgagcacatacaatatagtagttaccagaagagccgaggatgatccggagaatgcggataagcaggataactggaagaagttcgatataaatggcacagagtggactatggtaaatgacattcctgaggatgttgttcctgaaggctttgagcactcaaagacagtgattgacggccttgaatacaatacccttcacggtacctttggtgatatcacgcttgtgtatttacagtcagaaagcggcaatgggctttttgtatatgatgctgcccagaatgcagcgtatgagtatgtccgtatcaattccgagtcacattttatcgtagttttactgcttaaggtggatgatgtgcctgaaggatataatgaggtctcgctctccatagagggcaagggtgtggcaactgcctaccagaccaaagccgaaaaaacagatgataagataaaggatttttacctcgtatacgccatgaatgacaatggtgagagtggctggtatacatatgatagcgtagatggcacatatatgaggaccgagctcagtacacctaccgtggcacaggaggaaaacgatgcggtaaagagtgagcttgttccgggaattgccaataaatatctcgttttagccgcaatacttattcttgttatcattattctggcattacttcttcttgtggttgttgtgaaaaataagaagcgcacagcaaatgatgaagatgatgatgaagacgatgaagaagacgataccaaagagcttgatatagaggataatgatatagaagacaatgttatagaagatgacactatagcggaggataatgaagaaaatagtgatgaagagaatgatatagaagctaatgatgatgctcaggaaccggctgaagagttacagacagatgagattcaggaacctgttgaagagtcacaagtagatgagattcaggaaccggctgaagaatcacagacagacgagattcaggaatccgttgaagagtcacagactgatgagcttttagaatcagatgaaaatacggaaagcacggaaagtacagaagcagcagatgcatcctatgtcggaagaaccgtagaaattacacctgattctaagaaagcagctgaaaatgacaagtctgattttgctttaaaagaggattcaaagcaggtaaacgtttctgacacagaaaacgatgctgatgaggatgctttaaagaatcagcttcaaagggcaattgatggatttgtcaatgagggaaataagccgtctgagactgtagctggcagtttggaggacgacaatgaagatgacagtgaagatgacgatttacagttcatcgatttaaattagtgaatatatgactggaggatatgacttgaaaccatatacaagtaaggctaaaaaagcaatcgatttggctgcacgtatatcaaagaaaatgaattacagctatgttggaacagagcacatactggctgggcttataaaagagggaaccggtgtggcagcagaggttcttacagcctgcaatgtggagtatgataagcttatttcgatgattgaggacctgatttcaccgggggatgacatcgaagtgctggacagggacggctattcaccaaggacgcagagagtattggagcgtgcatccgaggaagccgatagatttgagtgcaacgagataggtacagaacacctgctcatggctatagtactgcagggagactgtgcggctgcgagacttttaaatacgatgggtgtcaacagtcagaagctgtttatagatatacttggtgcaatgggagaggatccttctgcatacagggatctgatgaaaagctacaatacctcgtacagctctgcgacacctgtattagaccagtattcgagagatttgacagatatggcagaggcagggcttcttgaccctgttataggcagaaaaaaggagatggagcgcgttatccagatactttgccgccgtggcaaaaacaatccatgtctgattggagagccgggagtgggcaagaccgctatagtagaaggacttgcgcaggatatagtcagtggcaatgttccggatattcttttgggaaagagactggtttcccttgatatgtccgggcttgtagccaaatcaaagtatcgtggtgagtttgaggagcgtatcaagaaggtgataagcgaggtttcaaatgccaaaaatgtactgcttttcattgatgagcttcacactataataggtgcaggaggagcagaaggctcgttagatgcatctaacatattaaagccggcacttgccagaggcgaggtacaggtaatcggcgccactaccatagaagagtaccgcaaatacgtggaaaaggatgctgcgcttgagcgccgtttccagccggtgatggttgaagagcctggtgtggatgagacaatagagatactcacaggattaaagggaatctatgaaaagcatcatggtgtcatcataacagatgagggtgtgaaagcagcagtaaacctttctgcacgatatataaatgacagatttttacctgataaggcgatagacctgatggatgaagcggcagccaggataaggcttaagaatctgacatcatctgacgagttgcttgctctgaaaaaagagataacagataagcagaaccaggtggaaaatgctttatcgaatggagatctcgcagctgccggcgcgcttatgtcagaaaaggaagtacttgaaaataaacagcagaagcttatgagaaagaactgtcgcacaggagccaaaaatcagcctgtagtcggcgaaaatgagatagcggatgtagtatcgggatggaccaaaatacctgtaaataagcttacagagtcagaggcaggacgacttgcaaagcttgaacagatacttcacaagcgtgtaataggacaggaggaggctgtttctgctgtcgcaaaggcagtcagacgaggccgtgttggtttaaaggatcctaagaagccgattggctcattcctgtttttgggaccgacaggagtaggtaagacggaggtgtcaaaggcgcttgctgaggctgtctttggcaaagaagatgccatgatacgtgttgacatgtcagagtacatggaaaagcatagtgtttcaaagatgattggttcaccaccgggatatgtgggccatgaggagggcggacagctctcagagaaggtcagacgcaatcctttttctgttatactgtttgatgagatagaaaaagcacatcctgatgtgttcaatatacttttacaggtgcttgatgatggtagaatcactgattcacaggggcgcacggttgatttcaagaatacaataatcatcatgacatcaaatgcaggagcttcttctattatagaaccaaagcgccttggctttggcgctggtgaggatgaaaagcaggatcacgagcgtatgaagaacagtgtcatggaggaggtccgccgtatatttaaacctgagtttttgaaccgaatcgacgagactattgtatttagagctctcaacaaggatgacatgaagcatatagtgacacttcttgtaaaggagcttaagaaacgctgtaaagaacagcttgatatagagctcacagtgcgtgacagtgcaaaatcctttatcgtggacaaagcctatgacagaaaatatggcgcaagacctcttaaacgaaaacttcaggaggagattgaagaccgtatgtcagaggatattattaccggcaaaattaagcgcggcaataaggtaataatttctacgaaaaacaaacaaatttcattgactgttgagtagaattggatttataattaatatatcaatatagctacgggaggataaaaatggctgtaataagtgaattaatccgtactgaggaaaacggaaagctcagcttcggagattatacattggctgcaaaggcaaagcttgacaattttgagaaggatggagatatctacaaggtaaagacatttaaggagattacaaagctcgaaagaaacggactctttgtatacgagtctgttccgggaacagcggttatggatttcgaggagactgctgatacagtgacatttactgtggagggacctgaggatgctcagattactcttggccttgaagaggagacagagtacgaaattgatatagctggagctgttgcaggtactatgaagacaaatctcggcggcaagctcagcttaagcgtagagcttgagggtgttgattcagtcgatatcaaagtatcaagaaaatagagcatatttttagcccggtgaaagccgggctttttgtattttataaaggagaacaatatggcaaaaggaaagacctctgtatttttctgccaggaatgtggttatgaatcggcaaaatggatgggacagtgcccggcctgtaaggaatggaatacatttgtagaggaaaccgtagataaaaagtcgataagctcgtcgggaaaagtaaaaaaagaatcaaaggcggcacaggttctgcctctttcggcagtaaaaagcgagaaagaggagcgtatagtgacaggtatagccgagtttgacagagtgcttggtggaggaattgtgagggggtcgcttgtgcttgtgggaggagatccgggtataggaaaatccacgctactacttcaggtatgcagggaactttcacaaaaaaaggtgccattactttatgtgtcaggtgaggaatccctgcatcagataaagatgcgtgccgacagacttggtgattttacggattcactggagcttttatgtgagacaagtcttgatatagcaaaggacgtgattcaacgaaaaaaaccggaggttgttgtaatagattccatccagactatgtacaatgaggagatagcgtcggcaccgggcagtgtctcacaggtcagggagacaaccggagtgcttatgcagcttgcaaagactctgggtatttctgtttttatagtaggacatgtgacaaaggatggtgcggttgcggggcctaggacgttagagcatatggttgatactgtgctttattttgagggtgacaggtatgagtcgtacaggatacttagaggtgttaagaacagatttggttcgaccaatgagataggcgtatttgaaatgaaggcggagggacttgttgaggtggaaaatccgtcggagtatatgcttagcggtaagcccgagggagcatcaggatcaattgtcacatgttccatagagggaagccgcccgatacttctcgagatacaggctcttgtatgtcacagcttttttaataatccaaggcgtacagcaaatggcacagattataataaagtaaatctactcatggcggtccttgaaaaaagagccaacctgtcactgtcagactgtgacgcttatgtgaatatagcaggcggtataaggatgaacgaaccggcgatagaccttgggatagtgcttgcaatcgcatcaagcaaaaaggatattatagtgcgtgaggataccatatgctttggagaggtgggcttaagcggagaggtacgcggagttaccatgtccgagcagcgtgtggctgaggcaaagaagcttggctttaaaaagtgtattgttcccaaagtgtgtcttgcaggagtgtcgcatattagtggaattgagattgttggtgtggcaaatatcaaggaagcgatagaggctgtcagatagtaattgtgagaattgcatataataaacagacaatttagaaaatttgtgttttttaagatagttttactactttaattaattgcagtaaatccgttgacatatgtgtgccgggatgatattatatcaaagctgactcgcgggacacattgagttgtagagcttgtgagttacattttacagacatgactttatagatactgctttgaaaataagttgaaaaagttatgaaaaaagttcttgacaaatgaaaaacattttgatagaataaacaagctgtcgcaagacagagaacttaaaacagagttcaaaaaaataaaaaagtgcttgacaaacgaacagcgatttgataaaataatcaagctgtcgcaagaaagcaaaacaaagaacattgataactgaatagtgagaaaccttgaaagattttgagaatcaatcagaacgcttcaatgaaaattgaagacctttaaaacagtaaattcagaatttgtgcgaaagcgatgaaaacaatctgcttgcagaattgtttgaggagctacggacagttgcaaatttatttgcaacctgaatgaacgaattagccaagtttaacttgactgagatcaactttttaacatgaccgggcggattcgggactttaacccgttagaaacgtgcgccgctaggcgcacaagacaaaagcaggagcaaatgctcctgctttatccggatacttatctttttaatgaatgactaacagattgtaaaagaataatccttatcagtctccgcactgatacgataatcctcttccacatcagttccccagctgtcgatacctccaacacctcttactgcgccatatatgcataaaacagttcttcttgccggtggcagttcttcatggtgaagagcgttttcaatctcagatgcggtataaggcagacaagaaaatgcaaatttttcatcattcttttcaatgcgcagtgtctgtgacgagctatctgtcctgctgttatcaagagccgtatgtcttgtaatttcaagccactctgtatccattctcataccacattcctgcggaacaagatattgtgtaagactcagatcaccgatctcatagacgccttcttgtgcacctgcttttctgtcaggatatgtttccccggagagtcccttatataaatatttgtcagccaatgttggcataataaatctcattccaaatacaggaaattcagggagcccctgtactccattataatgtacatccacgcgaatctttccggacgcatcaacgctatagctcacaagaacagttgtcgccggagttgttatggtctcgtatgtatattttacaataatttcatcagcataaacatcaccgccatagctgttattatcaggtgcatatgggttttgctccttgccatccatgatcacctgtattcccttacagtcaataaacatatctgccgaaagccagcttccgcttttaatatgaaacttgcttcccctgtcattatctgtcaacgctctccagaaagtaggctttgggcaacgatacagccactcatatccatttttaacgatagattccagtccaccctgtgcataagagaaaatataatcaaagccttcaccatgtacacctaatgtatagtcaccatagaccactcttaatttatctgtataagccatagtaatacctcacttcctgcattgccggtttttctttcctgtcagcaaatacaattccatttgctgagaattcatagtctgccggtttatcatcaaaatctccaccatagcgtaaaacatcttttcctgtaacggaatcttttaccataattgcctgatcaataaaatcccatataaatccgccatgatacatatcgtatttgtcaatcagcttcatataagagccaagtccacccattgaatttcccatgtcatgcatgaattcgcataaaatatacggttttttcggactgttattcaagtattcctctacatcctccggttttgcatacattctggtctcaaaatcagaaatagtatcctcatatgccctattataataagagctttcataatgaactaatcttccatccttcttttcggcaaaataaacgttcattgcctcaatgtcgtctcctgcataggattcatttcctaatgaccagaaaaggatggatgtatggtttttaaaagtttcgaaattgttttttgcacgctcaagcactgcatctctccactgtggaatagatcccggtacattgcatgacggttcgattgccccaagtttttggaatgagccatggctctcaagatttgtttctgccatcacataaatacctgcatcgtcgcacatatagtaccatggtatctggtcaggatagtgacaggtacgcacagaattaatattgtttcttaacatacatgatatatctgccttcatgtcttctataccaatacatcttccggttcttgcattccactcatgacggtttactcccgtgataacaagacgttttccattcaaatagactactttatctataatctctattcttctgaaaccgatatcataaggaattacctcggccagtgaaccatcctctgctttaagctcaacataagcatgatataaatatggattatgattgtcccacagcttgacactttccaagtcaacacaaatcgtgccttccaaatggttgttttctttatttaactgtaatgacttctcaactaatatattttcttctctgtcttttaaaataaagccagcagttacattctgactgtcaggagcagataccttcatgctgacagatacgcttccgctttcattatcttgatttaacacaggtttgaaccatacatcctccagatgaacatccggaattgccttcaaagtaacatttctgaaaattccaaaaaatctgaaaaagtcctgatcctctaaaaatgccgctgtgctcatcttatgaacctgcactgccagaacatttcccttttccttaatatatggtgtcagatcaaactcagaaggtgtgaagctgtcctctgcataacctataaactgaccattaagccacagatacatagcttcttctacaccttcgaagcagatatgtattctttttccacacatgttcttatccaaatcaaagtatttgatataagagcctaccggattgtactgtgcttctgagaacattccttcttctgctccggttgcctccatactatatgctcctctgtggtactcttttccttcccacggatacatagtgttgatgtaacgtattttatcatatccagccagttcaatatgtccgggaaccataattttatcgaatccggatgcatcaaatgtttccttataaaaatcaacaggtctttccatcacatttttgctgtaagcaaactcccattgaccatttaatgactgtaataacggatttttttcttttttcatgtctgaataatccagataatagcaatgatcactatgtggttccaattgatttaccttaaacacttccggattatcaagccatttcatatcagcgttcatatttttcctcactttccaattattaatatataaaaccaagaacaataactgctttgctacatctaagatataacaaaacccttgcaaagagcaatgtaataaattatacaaatcatgcactaaatgatactgttataattactgtattataaaatgagggtcaaaaggtgtcattgatgcttgcatgcaatttaaaaagctcccgtgcattgcacagagagctttttagtccggttagtacagacatatattaacacgcgaattatatgatgacacttgctttccctttttttcaaatctttggattcttgtaataacctgatattccatctgcagcttgtccgatgaacaagagtatacacaaggttcaaaaccggtatattcatcatccccttgcgtataattattcccataataaaaattctctattatatttgtctcaaaggaagaatctatttttgattctgactcttttggatcacccatagaataatcactgccatatgtctttgcatataaatctctcatcactgcagcctgtgccttaggactatccacatctgcacaataatatgtaatataaaacggtactccaagcaccgcatcaacagcgaccagcattctcgtatcttcaaatgatattataaatatccacgccgataattccttgcttatatccgatgttacaaaacaatctgatattgtgttgtcaatactatcatccaaagcaactgctgcaccatattgccaaggagctgcttcatatgtctgttctgttttactgtctgtatcctttgaatagttactttcaaggctttggagcataactatatcgtcttcaccgagcatctgcataatacctgactgcttctgcagctcacaggcacccttcagaaaagtctgaatagccgtataagcctgtcccaccggaatctcagtatccaacggttcccttttctcattatatttcccattccacagctcatttacattgtcctgcatcagagacatcatcttagtaagcctctcttcagctgaaatagagctgctgtaggggcttatatctgcgttgcttattgtagtactcgttttggcaatttttgctgctttaagtgaaatcagaaaattcggtatcatatttccggcacatacaactgccagaataatgcatatacacactattcccttgattttatccggttttttatcaatacatttgcgcactgataaatgcttacttctcatccaatgcctccgctttcatgtcaaaatacaccttggttcctttacctgactcactctcataatggatttttgtatcatgcagctcagcaatccttgatacaagtgcaagcccaagccctgctccatgctcacttctcgacctcgacttgtcaaccatataaaaagcctctgtaatgcgctctatatcttcaggcggtattcctcttccattgtccgaaactgcaatacgataaatactgtgcgaaataagtctgcctgatacatctaccttgctgcctcctgatttcactgcattgtctatcagattaagaagcatggtcttaaacagatcatattccagccacacccatgcctcatccgcactgtacacaatctctgtattatgctttcttgccgcttcatgtgcggtttccatgcaatctgctataatctcagatactcttgtttcttcaagcctgaaatcatttttatcaagagtaataagctccagcagcttaaatgataatgcttcaagcctcatgccctcattcagtatgactccggcagcactgtgcacctcatcctcggacatttttttctgatacagggtatcggcatatcctataattgatgtcattggggttttgagctcatgtgcgaagtttgcagtaaaatcctcctgcttctttgccgccatctgaagttcataaactttgctttcaaggtttttcgcaagctcgttgaaagccctcgcaagctcacctatttcatcctttgtctttacatcacttcttgctgtgtaatcaccatctgcaaattttttggtggtggctgttaatccggcaagaggctttgtaatcatccaggaaagtatcaatatgaccatcataccaacagcaagtataacaatgtagtacatgctgcatctatacctaagctcctttgactcatcgaaaaccggtgtaatatcactttccgttatcagaatatacctgttatcattcagtttaaagctgcttttgacatggatatatctgccgctttgcttttcaccggtatctttagtattctcttttgacactatactgtatgtaagcgtaccatcctttacctttatatccttttgctcataattacatgaattggcatatatcctttttccatcatcatcagcaagatacattcccccttcatctccaacaatggattttgccgactgcgacatcatatctgtaagctccttatccacatcctcactcttcatattaagtatgacagtttcaatcgagtattttatcatctgatgctgcgaaagtgcactgtcctgctcccttttaactgcatgctccagcgaatatgatagagtcacatattctatcattccaagggcaacagccagtatcactgtcattccaagaaacattttatagaaaaatttcatccgcgaacctccagacgatagccaatcctgaaaactgtgacaatcttttcattccagtcaagcttttttcttagtctttgtacatgtgagtccagtgtccttgtctccccggtatactcctcctgccatacaagttcataaagcctgcgcctgctgagtgcaacattcttattcttcataagctcatacaacagatcaaattcctttactgtgagctctacctgctcacctgcctttatcactgtacgtgatttaggatctatagctacatcctctatttccagacgctctaccatgcgctgagtgcgccttaatacggtttccactctcgcaagcagctcccctatctgaaatggtttgcatatgtaatcatccgcgcccatacgaagcccgcgtatcctttcatccacctgtcccatagcagatattattatgaccggagtatccccaattctcctgacatagtcaagcaattcataaccatttatctcaggaagcataatatcaagcagcagcagatcatatctgttctgctcaattttgtccgccccttcctttccatcaaacgctctttcgcattgatatccctctgccttcagggtgttgcatattaaattatttatgtcgttgtcatcttccactatgagaatcctggtcataagctgctcctcttctatgattatgataaaattattatagcataaagatgtgtcatagttgtaaaaaacaccctgttatttaactcaataataggatgttttaccggcacttatacaaatatattctcacacatacatactccagacagctctaatctgagatgatatatttttgaataaccaccttttgccacttttttcaatgctgtttggatcatttattgaaaatccttcatcatcatagcctgttataaccataaaatgtcctgtatcggtaaaatctcccggtcctacatttaccacaataggatgtccttcatcaagctctgccttcattctgctctcatccagcgccactgtctttgcttttacgccgtagtgcctgcagccttcacttataagcgtccatgaacttcctgaaccatccacactgtaaccggcttcctttgaatactttgctactgcaataggtgatgcctccctattgtgcgtcagataaaccactaccatcgaaagtgtagtgggaccgcatccgcttgctgcaaagaaattgccgctatatttttcgtagccccagcgtttatcccactgcacaaataacggaacactatccatagacgcttcttctgtcaaatcaattgtgtgttccttcgcatgttccgccggataatcatacacaaactcgagtgcctcttcattcttcaaagcaaggtcctttagctgttttggatattgggtgctgttcattatatcatcaagcatcgactgattattttgtatcttattcttttcagagattttgctattttctataacagcattatcatatgtattatttccggcttcaacatcatatttatttgtcctgccatcaccggatcttatcatacggcttccaacagccacaaatacagccacagctatgatactacaggaaaatatgatagaacgcagtatttttctgcgcctgcgtctccttcgacgtaaacttgccccatgtctgcaacatttattttgtgtcatgtccactttctaccctcctgcttctttgtaactgatattgtgtatcattactctatcaaaagcattcgtttattatgttgcatacttgtgtcatagttgtaaaatattccaatattaaattgtataaataaactgaccaatggcagtattgcaggatattttaacctgtcactgtattaagcaacttttgactatatattctgttattttggcaagtaataattcttttcgtattctataatggcatcgtaaacagaaaggagatgaatttccatgagaaataaattacacaattttattaataacttacttagcttttatgcaagcttctttactcacagattttatcaaatgtaatgtgcatagcatacataaaacacctgatgtcccccatatccttccactaaagctatgagttgcattccagttttcttcatcctgcaatgtccatacgattctgattcctatcgtattgttctgcttaatctttggcaggtaatttcctataacaataaacaataaacttgttccataataaattaatgctaaaaataaatccgctgtttttgctctttgatacaattatttataataagttatagattctaaactgccatgagtatttatactttggatatacgtattatcataataaaagtattctcctaattggctgccataagtttcttctaacgtaagtacaataatagcataatttccttctgaaaagtagtctatgaaagctcctctggcagaaggacatctttcttttacatctaatgctattttttttatatcttcgttctctacaattattttattataacttgaatctcttgttgatatttcaacaccattagtatatataatattataatttaattttttagcagaaaatccttttctattaaataaatttttctgtaaagttatcgttacaggtttattatttataatagcaatataggtatcatcagattgtataattccagtttgatagttgtattttaataaataattacagttatttattacatataattcatacacataaggaattataaaaacaataacaggaattatacttaaaatgatatattttttgatacttaaaatattataatcagtattatttgatttttttatttttctatttatacaacaaatacttactatatgaatgataaatgatattatagaaattggaaataaaaatataaagtcccaacctatatctactatttcactaccacataaataaaaactaatgaaattaaatattatatatataattatgacttttcttaatttctttaaatcactattcttcataaaaattcttgttaaaaaaaatattgacattattaacaatataaaaacattacaatatattgcactttttaacataaccactttcctctctttctatataacatttaaataagctatctatacctttatacaaattatatcataaaatttcaaaaaagctgacttgaaaaagtaaattccagtgcaggggtaaattccaccacgctttaaaattctttgattttttagaattgtgggaggctaaatccttatgaaacggcaactactactgtagcaccaaccattgggttattacccagagtgattctctctcatatcctgtcaaatcatattcttttttattctattatcctttcatttcaatcattttctgtatatctaatggtttcgacaggtgtgcccccatccctgcagtctttgattttttcatgtcatcatcaaatgcatttgctgtcattgcaataatcgggatgctttttgcgtcttctttctcactgtttcggatttcatgtgttgcttcatatccatccatgactggcatcataatgtccattagaattgcatcaaaataatacacattgtgttttcatgagatctgtttcatttgtttccgaatcgtacaatgccaattcttttaatttattccgggtgctctcgttgtcgagaccagatgacatcagactcttacgattcatagttctcaattttatttgcggagtatttataatccatacaatatcgcctgtcgatcagccacataaaattcataattacaacatcgttcaatcaattccctgtcatgggtgataataaaaatacttttacccatgtcacgaagttctttaaacagctgtgcagtacttaccatatgacaataatccagaccgctcgtcggctcatcaaatatcagtatctccttttctgcaagcacagacgatgcaatagccacacgctgtttctgaccaccggataatgacatcggatgtttatcacgaaattcccatataccaagtttttgcataatttctctggctctttcctgtatctcttttccggtatccgatgctccaagaagaacttcatcttctacagattcacagaaaagctgatgatttacatcctgcattacaagataacatttacggagcatttcctttggtttatactgcttctcttctatgaccgtctgtcccttaaattttttctccaatccgcaaaagcatctgacgaacgtagattttcctgctccgttttgtcctgtaattgctataagttcattctttgggagctgcatatctccaaactccagtacctttttttctccataggaaaaataataatttttcagtactatgtccgactttttggcaatatactcatgtcttttactgctttcatcacaatgtggctgcattgtacgaagtccgagattttgcagcttttgctctgaaaatttcagaaattcctgcattgtgatatcaaacataattcttccatgttcaagatagactacacggtcacatatttccttaagccaatacaacctgtgctccgctatcacgattgtttttccctgctttttccagagtaaaagcgtattttttagtctttctatggattctttatccagatttgatgtcggttcatcaagtacaaatacgtcgggctgcatcgcagttacagaaccacaggcaactctctgcttctcaccgcctgacaatttaaaaatatctctgtccataagattttccatttccagttcgcttacagccagttttacacgttcgttaatatcgttttctacaagtcccatattttcgcatccaaacgcaacttcacttgttgtatccatgcagaaaaactgacttcttggattctgaaatacactacccaccttttttgatatattatatagttcttcactctgcacattcattccataaacgctgacatttccgctatactctccttcataaaaatgtgggataagaccatttataaggcgcgttattgttgtctttccacaacctgaagccccacataacaaaacacattctcctttatcaactgaaatcgaaacatcttttaacgctcctttttccgaattattatactgaaaactgacattttctatctgtatcataatatcctccatttgtaacaaaaccgcactctgccaatatcatgacatcatgcggttttatctatatattacataaataatcttgaaatcattgaaacgatccatattacataaggaataaagcaaataagtactacaatatagtcctgaaaatgaaaaccaatccggcacacattggtccgctttacatcaccgccaagtccccgtgtaatagctgcggcattgagctcctctccaatttttgcggagcagaccataagtggaatcagtctgtactctatcattttatcgacatttttcccgccgaagcgaatatcccgcatacgcatcgcatcattgattgcccggaattcatccgcaatcgttggaaaaaaacgaaacataacagaaagtggtatggtcagcttatccgtaatatgcatcctgctcatagccgaagaaaactcacttactgttgttgtctgcatcagataggttccagccatgattcccggcagaaaccttgtcataatcccgcagaatgcaagcaatataaatccaataaaacctgtcatatgaggcagcacaaacactgtcagcaaataaaatacactgtacaaaatgatatatcctgctgctcttttccacttacctacaagtataaaaagcacgaacggaagcagacagaataacggaaggtacgcaccaaataatttatctcctgctcctcccagaacaaatattgccattgtcattaaaagaagcattttcgttcttggatcaaatgtgacgtatttatgtatcattatgcaattcccgctttctcaaaatgctttttcaacaatgattttccaaatactcctccgatccatccacaaaccacgcatgctgcaataagtaatgggatcagccatgagttcgcaaagatatctgtcattttagtgatatactcctgtccaaaactctgacgcgtactgaaatatgcctcaatattcataaacattggaacaaagtttccaaagatgatcagattaaatactccacaacttaatatatttttcttactgcttttataatttcctgattttacaataaggtctgtaataacaccacatataattccaaaaataaacggccagtatcccattcctgtaatccacaaaaacaatccaacgatcatagcataaatagttatcattccaaatttatcaacttttgtcaaaaaaagcatatatggaataccgccaaatattgggacaatcacacataaaagcggcatcatgatcggtataaatcccagcattgcaactgctgtcataatcacacagtaaatcgctgcataaattccaatattgatcaaatcttttccttttaatttctttttatttttcattttgaatgctccttgttttttatctatatattactttatttcttaacgtgccagtttccagctgactgcctgctctcttgcatccacaaaccgcttgtaaattccttcctgcttcatcagctgctcatgggttcctttctgcacaatctgccctttctctacgaccacgatctgatctgcatggcgtaccgtcttcagtctgtgtgcgatcataatgatcgttttttctttcgtcagtgcatccacagcctccacaagttctttctcattctcaggatctacattcgcagttgcctcatcaagaataatgatcggtgcatccttcataatcgccctggcaatggagattcgttgtttttcaccaccggaaagcgtggcaccaccctctccgatcacggtattatatccatttggaagtttgctgataaactcgtgacagcaggctttctttgctgcttccaccacttcctcatgacttgcatcctgacgcccgaacttaatattattctcaattgtatctgcaaaaagatagacggactgaaagacaaatgcaaaattattcatcaggctgttcatgctgtactcttttacatttacaccgccaagggtcacttctccggaatccacatcccaaaatctggaaatcagattacaaagtgtagatttacctccgccagacggaccaacgattgctgtcgttgttttttctgggatagagagtgatacaccatcaataatcttccgcttatcgtaggaaaatgtaacatctgaaagtctgatatcatagttttccggctgtatctctttgccatcgatatccatcgtatccagttccagaattgcatttgctttgtccacacatacacttaccacatgtaagagggatgagtaatttcctgtacattccagactggcataaagcataaatgctgagattgtcataccaatggcataaaccgcactcatagttccattgatataaaaatatgcactgcatgccacaattacggctcctgttatcttcgttatcacgctttgtaaaaaatgatacgggacaaataccatttccattctggtattgattttggcactcgcatcgtttgcatcatttaatctctttgcctgttttccaagcagattgtaggatttcacttctgagattccctgaagatactccatgatctgacttacgagttctgtatcacataccaccttttgttccgaatcttttttccctgcattctgcatcatagaatttacaccaaagaaaatcaggactccagctgcagatatcagtccgattctccaatcaaagacaagcagcataaggatgatcatcaaagtctctaaaatcccctgcgttgtcagcataaccaccctggccgctacatctcctagtaattccatcgtattggttgtcaccgaagatatctctccaatactgttggaattaaaatatcccatcggaaggtaacgcagatgctctgcaattttgattctcgtaaaagcacttgcattatagccaccttctgtctgaagtaccgtagaacttctcttacatataacagcaatcacaatcgcaatgaccataatggctaaggaacctccgatatattttcctatcggttttccaccaagcaaaccaatcaatatgtacataatggctggtatcttcattgcagatgcaagtgcttctacaagcccaatgaccatcgacagtttgaatttgtttccattttccctccctgaaaatcgaaagaatttcgccagaatctcaaacatatcatacgccctcccttacggtatcttttactgaaatatgggcattccacatttctttataaagcgggcatgacaccagaagctgctcatgcgtgccatgcgctgtcacgtttccatcatttaccacaaagatctggtcactgtccttaacagtagaaagcctgtgtgctatgacgatcagtgtctttccgtccaccagttttgcaatggatttttgtaatagagcttcgttttccggatcggtgtaggcagttgcctcatctaaaatgacgatcggtgcatcctttagcatcgcccgggcaatcgagatacgctgtctctctcctcccgacagatgtccaccggcaccgcctacaacggtatcaaatccattttctaactgcaggataaattcataacagccgctcttctttgtaacctcaaccacctggtcatccgtagcgtttggatttccctgtctgatattttcacgaactgtctcattaaacagataattgtcctgcgcgacataggcaattttccggttgaaatctgtaagtgccagctcttttacatcaaccccaccgattttaattctgccggaatccacatcccataaagatgcgattagctttgcgatcgttgactttccgcttccggaaggcccaacaattgcatttacagtccctgctttcagttccatatttactccatgcaggatttctttgtcgtgatagccaaaccttacattttcaagaatgatggaattatcttttggaacatctttacttttctccggacgttttaactccggctgttctaaaatacctgctatctcatcaacgatcactccgattttcccaaggtcatctgtataggagcccaccgtgatcagaggcccgacaattcccagtgagagaatgatacaaatgacaaaatcagataactctaaggttttattcgatacataataggctccaaaaggcaatactgtaagaagtgtatacggtgtcaccaccatcatcaatgcatgatagacagaacatcttctcatccatgaaatgaaagagtccgcatattcccttgccgcttttgtaaatttagcataagagctttctgtctttccaaatgcctttatgacctctattccgttaatatattctaccgcagcatcattcagctcttttgtggtcttaaccgtcctttcaaaacttggcttataatccagcatcattccaaaatatgagaaaagtccaacaacaatcggaactaaagaccaaagtgccagccgatagtctgtcaggaagaaataaatcaggattacaaccggtgcaagcagattggaggtaaattctggtactatgtgagccagagttgtctcgatactgtcaattctttccaccatgatatttttaaaagtacctgacggtgtatctttcacatacccaagaggtaccctggcaagcttgtcgcaacacgcttttcttatatttgcaagtaccacaaaagttgctttatgtgacaatgacgttgaaagtgaatgaaacagttctgcgatcacaaacgacagtgcgatcaggactgcttttatcagatatttttcaaactccttttcaccgtttaaaaacagtttcaccacatccgcaattataaagtacggaagaatcttaaaaataacatttcctattgcgagcaatacactccacacataggcacttcttttttgtccagcccatgtcagtatccagctgactgctgactttttcttttctttcacacgtattcactccttgctatagttttaattttgttagttatgtctaacccttgtataataaaataggtggcatgccggcatcagccacctgatattattttcttaaaatgtacctttctgaatcgtaagcctaaaatttaacgttccacaatcgctcccagccaccggtattgaattcccgaagcttgtgcacatttctctttgcaatttccttatctatatcgtgctcaatgatctgaaatatagatgaaaaaaatccggtataaatcatatgcatgaggctttccccgacaatcggtatttcaattccatcctccttcattttcttcacatattccaaactggatctcatttccctgtctaccatattgtgtatgaatgtctcaaactttccactgtctccacatttcagcaataatcggaaattatcataatgctcatagatatagtcaatcatctgatccattccgtcgccggatgtgtccgacatattactggtctgttctttggcagaaagcttttcaaaatcctcaactacacggtcgtagatctgatatatatgttctatatacggatctgtcagtgcatcaaaaagcgcctcttttgtcggatagtatttataaaaggcacccgttgtaagtccggcatcctttacaatatttcttaaagatgccccggaaaagccatcttttaaaaaatgctttctggctgtatttaatatatttttctctgtatcttctgcttttgtcgacatctttttcttattctcctgaacgtctctccaaaatataacagtgttatatagtactgttatattttatctcattctattcatttgtcaagtataatttttagatttttcacaactggcaaaccatcttttccacattctacacttgaaacacatttgcctttctcaaacactaataaagcaggagtttgagaaaaagaatatttctgtttaaattttttccaacattcctcactttctgacctcaattcttttagtaatctattgattgaatatcattgactgctaagtattgttttgcgtttcataattgtttcctccttttgggcataaaaatagcacctaacagatttttaatttccgttgggtgctattgataacactacacttatttgcttatactgatttcttttttacaatacgtaactcatatcctaaagcatcaagtatatgactaaatgctcttattgtaggaatactttctttccgttcaatccgtgaaattacctgttgtttatttccagttaatgaagctaattccttttgcgttatattttcttgtttccgtaaagaaatcatttcacctatgagcttatactcggcacgggattcatcccatgcctttttaaattctggattattttgtctttgcttttcaatttcattttttacattgatttctacaaatggcattttgctacctccttatataaatgttttgcctagttgttttccaagttcagatgctcgttttcggacaagtttttgatctgtcttttccgttttatttttctgtttacggcaagcatgaagcaaatatatattctctttatcaaccgtaatataaaatattcgattgtgtttctgaaaatatacctcatatactttcttttcccaacgcttgaatttgattttatcaaattcccccttttccatgcattccataacagataaaccatctgtcttttcatcttctggtaaactatttatataatcaagtattaagtctttaccagaattagagcaataatcgtgtagtgtcatctataatcctcgctttctcttttgtcgattacagaatacaacatataggttgtatttgtcaagcgcattttaatttccgtgagcagtatacaagctgtccgtttgcgttttctactgcaattatatttttgaaaagcataaatgctataatccgtaagaagccgtgtatcatttctcttccagcagaattatagagcgtgtttgtgtatggatctgcgtaatacgtttcggttggtgtgattgctttaattaatacatcgcccatagtcatactcctttcaagaacagatgttcctcttattaggagtataacatacctcgtccacattttaaatttacgtggacgagatgtggacatttcaatattattctcgtccacatgtacttttataaaaaaatagagagccttcggatttctccaaagactctccaaaaagcccataaaatcaagctttctatttagaatttgccctcatcagcagcctgctgaacagaaacggcaactgctactgtagcaccaaccattgggttgttacccattccgataagtcccatcatctcaacgtgagccggaactgatgaagatcctgcgaactgtgcatctgaatgcatacgtcccattgtatctgtcataccgtatgaagctggtcctgctgccatgttgtctgggtgaagtgtacgtcctgtaccaccgcctgatgctactgagaagtacttcttgccctgctcgatacactctttcttgtatgtacctgctaccggatgctggaaacgagttgggtttgtagagtttcctgtgatagaaacaccaacgttctcgtgatgcatgattgcaacaccttcctgaacatcatctgcaccgtaacacttaactgttgcacggagtccatctgagtatgcatgctcagatacgatgttgagcttagctgccttgtagtcatactgtgtctctacgaatgtgaatccgttgatacgtgagatgatctgtgcagcgtcttttccaagtccgttaaggataacacgcagtggtttctgacgaaccttgtttgccttctcagcgattccgatagcaccctcagcggctgcgaatgactcgtgacctgctaagaaacagaagcactctgtctcctcctcgaggagcatctttccaaggttaccatgtcctaaacctaccttacggtgatcagcaactgatccagggatacagaatgcctgaagtccctctccgattgctgctgcagcgtctgctgctcttctacatccttttttgattgcgattgctgcaccaactgtgtatgcccagcaagcgttctcgaaacagattggctggattttctttacctgatcgtaaacatcaagtccagcgtcctttgtaatcttttcagcttcttcgattgagctgataccatagctgttaagtacagcattgatctggtctattcttctttcatatgattcaaataatgccattgtcgttctcctttcctcttattcctgtcttggatcgatgatcttaacagcaccctgctctggagttacacgaccgtatgatcctgaagctttctcccaagctgtgttagcgtcatcaccctttttgataaaatctgtcatttttccaagagaaacgaactggtatccaattacttcatcgttcttgtcaagagcgattcctgttacatagccctcagccatctcaaggtaacgaactccctttgcctttgttgcgtacattgtaccaacctgtgagcgaagtccctttcctaaatcctcaagtcctgctccaacagcaagtccatcatcagagaatgcagactgtgtacgaccgtaaacgatctgtaagaataactctctcatagctgtattgatggcatcacaaactaagtctgtgtttaatgcctcaagaattgtcttaccctgtaagatttctgctgccatagctgcagagtgtgtcattcctgagcatccgatagtctcaactaatgcctcttcaattactccattctttacattgagtgagagcttgcaggcaccctgctgtggtgcacaccagcctacaccgtgtgtaaatcctgaaatgtcctcaattttcttagaatgaacccattttccttcttctgggataggagctggctcatgttttgcgcccttagctacaggacacatgttttcaacttccttagtgtaaatcatcttaagactcctttcgttatggttttaacatacccgatttattctctcatattttttgtcataagtctagagtatcatcgacaaaaaacaacaaaaatacaatattttttcaaaaaacattactattttttaagaactacgttgtccttgtccttaaaaatgtggtttgcagggatgactccgcgtactcttgaaagcggataaatgtttgaatttcttcctattactgttcccgggttgagcactgagttgcagcctacctccacatggtcaccgagcatagcgccgaatttcttgcggccggtttcaatctcctcttttgtatcgtaaacatcctttacgactacaagagtcttgtcgctctttacatttgatgtaatagagcctgcgcccatatgtgatttgtagcccaggattgaatctcctacatagttgtagtgtggcacctgtactgaattgaagatgattacatttttaagctctgtggagttacctactactgagccctttcctacgattgcactgccacggataaaggcacactgtctgatttctgcatcctcgcagatgatgagtggaccgtgcagatatgcgctgtcaaatactgttgcgctctttgctacccagatatcctcgcctcttttctcatagatttcagggtcgagtgttggtcctatctccttgatgaaatcacttattccggcaagtgcctcccatggataagtgaactgcgataaatactcctttgcgattgtttcatccagattatagaggtttgttatttttgcgttttccatttttctatgtcctttcttttatttattatgtgaaaattattgactatttttttaactgtcattttaatattaaacttaaatataagtattaaacataaatataaaaattcatattaattatagatttgataattaattataagcagagctactcaccgaacagctcatgcgccgccgcaagtgccgcctccgacacatcatctgcctgtgcactatcagctgccatatcaaatcctgccagaaattcctctgggattcccatctcatccatggttgtattattcatggttatctcgtccggcgcatcatctaccgtgctctgtgcatcagcattgttatatgcatcagcattgccctgtgcatcatcagcattgttatgtacttcagccgtgctatgtacttctgccgtgctctgcacttcttcctcacccgggttatcgaaatcaaatgatatctggtcattttcaaacttaaggcatgtatcgaatacatttcccgccttggaggtgaagcctatgaccttctttttggtctttcctgtggtaaacagctccgtgagaatttcctctgaaagctccacctttgccacagtatgccaaacattgaagccgcactcacactcatatttccactgtgtctttttgagaggtctgccacactttggacagagtacattggtctcgattggcttaggcttttcggggaaatcaaaggctatatctccatcttctgtgagctttagcggtgcgtcaaacttcatgcctgtctttgagacaaatcctgatataacttctgtctttttctttgtcagaagctccttaaggactgattcctttatcttgacgcttgcgaccttgcccaccataaagcggcagctctcaggatcatcacgtctgttgttctcgcatacaaagccaaacggcgccacctggattttgcctccgcacttcggacatactacatccttcactgtctttggctctacatggtcaaaatcaaactggacagagagcttcttgttttcatcctccttaagcaccagacacgcatcgaagcgtttcccgcttttggatttaaagcctcgtatggtctcggtctttttatcattaagaagctgctttaggtttgcggctgtgattgtctttcccgcaatctgtcccaccgaaaagcggcagcttcccggctcgtcacccttgtagttcacacagccatagccaaacgatgtcttttttatctgaccaccacaaagcggacagacaacatcctttatgatttcgtcctccacattgtcaaagtcaaaagccacgactgtgtgcattttctcactgccctctgtgacaggctctttctttaacataagacatgcgttgaagcgctttcccgattttgatttaaagccctttatcgtctctgttctaccgtttgccatgagctctaaaaactgtacctgtgacagctgcttgtctgctatccttccaacgaagaaatggcagccatcctctgtctgtctgttatagtttgcacatcggtagccgtatggcgacacatatatatcgcctccacagtccgggcatacaatgccttcgaccttttgcggctttacattttcaaaatcaaaggtggctgataccttgttcgtctgttcatccttgttgagctttaagcatgcatcaaagcgtttgccgctcttcgacttaaacccacggattgtgtcggtgattccttcttcaatcagctttttgacctgttcctccggaatatccagtcctgccacctgtccgatattaaaattacatcctgatttatcatttttgtaattggcgcagccataaccaaacggtgtggtcactatctcgccgccgcaaacagggcacttgacacctatctttcgtctggccgccgcacctctggcatttttgcctgcaaagctgctgatacggtctgcaatctcagggcgcagattctgctcaatcatcttttctgtctctttgcggataaagctctcaagctttcccctgtattcccagaaatccaccgtgccccttgtaattccgtccagtcccttttcccagttggctgtcatctttggattaagaagtgccggaactgtcatgtatacgacctcaaataccatctcgccaaggctttctggtgtgagtatctgtgtctttttgttcagattcagatatcctatacggacaagcttctggattatctccgctctcgttgctgaggtgcctattcctgagccctttatctgctcacgaagctcctcgtcctcgataagctgtcctgcattttccatggcaagcaccatggagcctgatgtatatcgctttggcggagatgtcttaccaaacttgatattatagccttggcatgctatctcatcccccgcctttagcttatcggcaagctcaagcatcaccttgggatttacgactatctcatcattgctaccgtttactgtgctgttttcatctgtactatctgcagtttcactgtttttaccaagtattcgtgcgtttgattcctcaaacgacttctttttcggcggattcgccacctgtaaatagccctcgctctttagtacctttgatgatgcaaaaaaactttccttatccacatctacgacaagcttcacattctcatactctgccggtggataaaaaatactaaggaaacgcctgacaatcagctcaaatactgctctttgaagcgatgtaagccccgaaagctctgtaagctgacctgtcggaatgatagcatagtggtctgttaccttgctgtcatccgtgtactgcgtatcagctatgttggcatatagcctcttttgcataatatgctccacaaagtctgctgtcggttcaaaacctttaagcctgcttatattttttccaatctcctttgccacagcgcttgagagcaccctggcatctgttctaggataggtggtgagctttttttcatacagatcctgagccacctgtaatgtctcatcagggctgattttaaacttctttgagcactctgcctgcagctccgccaggttgaaaagaagcggtgctctttttttagtaatattcttaactatagatttaactttcgcctgtttgccgtttaattcttcaattaaagcaagtgcatctttttcctctttgaaaccgttttccttgtataaaagcggtgattcaaagtaccttgagccttctacagccttccactctgcctctacaccggcatccgtaaacctgccgattaccctgtaaaacggagtctccttaaagtttctgatttcgcgctcacggattactaccattccaagcacacatgtcatcactcgtccgaccgcgattgccgtgtacgagcgtgtacccgctgcatcgtttagcagattgccgtatttgaccgacatgacacgcgaaaagttgatgcccatcgcatagtcctcgatggtacgcatgatgccgctctttccgaggtttgcatacgcactcatcggctttgcctcttttatgcctcttaggatttcctcctcggtctgcgaatctatccagactcgaagttcctccatgccttccctgacaccaccaaagtttctgatattctcctcgatggtctgtccttcttttccggcatcacctgcccagtaaactctgtcaatgtcctctctctgcaaaagagcgtgcacaatattgtactgcttgcgcacgctgtctatcacatcatatttgtattcctttggcagaaacggcagatcctcaagacgccatttcttatatttcatgtcgtaggactcagggtagaccagcccgaccagatgtcctacgcaccatgaaatcacatattctccattttctatataaccgtcattgcgtccgctcacccgcagcaccttcgcaaattcctgtgccacggatggcttctctgttattatcagtgattttcccataagctcctctataattcattcatgttgatgagcttgaatctagggtctctgaccacatagctttgcagtgcaggctcaaaatccgttgccgaaaacagataatagtcatcagatgtaagccttgcctgctccatagccatagccatattctcgcacatatccatggtcatcattggcttgtcccagttgcagaagccgatgatgctccttctatcctcgctctgagccacgatgtctatgcggcctgtctttccaatccatgtacccacacgctttatggtaaacggaagctgtcccatctgatttaatataagcagatactctgtgcagacctccctgaaatatctctcaagatacgcatcaagctctttttctatatatgtatcataaaactcttccggtgaaagcagatacagattagacatattcggatagacaaacttaaaccagaaattaacaaatgtgtcttttatctgatatactcccttctttgcattttcccatccgccggtctcaaatgaaactactttttccacgatattgaagttggcaagattctttaaatatacgctgattttggcacgtgaaaatcctgtcgcatggaaaatatcattgagcttgttctcgcctcttgcgattgctgcaagtattgtgctatatgcagaaagctctcgaagctctgcggatataacagcatccgcctcaccatacagtgctcccgatggtgtcaatacgagcctgcatatattatccttaaaggatttagctgcatcccacttatccagatatgccggaactccaccgattgctccgtaaattctcacgatttccgcgaccggaagactttcaaaatgtcttacaacctcaaggaaattgagcgatccaagcttcatttcggctcccttaaactgctctgctgcctcctgtgtagcccagactgtagatgatgtggcaagtattataagtacaggccccggatacagcttgtgctttttaagctttgcaactgcttccataaatgatgtatccctctttgccacaaactgtgcctcatcgattatcacgacgagcttggaagggtctcctgatttgattctcgcgaagtactcctcatatgtctgtctgctcaggctcaccttgtactgacggcttatctcctcccccatcatctcaagctgatgctctggcgatgcctgtctgcatctgtagtaaaagaatttctttccgtcacaaaattcctttatgagctcctccttttgacagcctctccttccgtagagcactacgagctggttacccgactctttatagagctgctcaagtttctctaaatctgtgtgttttgctttcataaatattcctccaaaataatcaactggaaatattatatcacaatttaacacatatacaaatagattttaattataatttccgagctcctattgtagctttcactttatttctgacaaacatatagcagatagcctgcatgatgattgtcgctatccatgaaccgggatatgatataaacaggaaaaacagcgacctgtggcttggaaacagaccatatatccagatgattctgactccgactgttcctattatagaaagtatcataggtacagttgagtatcccattcctcttagtgctcccggaaaaaggtccatgattccacacaggaaatatgggattgttgtaatcgaaataatctcaagtcctgatttaattacctcgctattacttgtatatatgccaagtatctgtgttccaaatatgtatgaagcacttcccatcacaagtgctaccgctgtcgtgaggaacagacagtctatcagtaccctgtccattctcttttgttttcctaccgcatagttctggctcgtgaagctcatgcaggcctgtgtgattgagttgacagatacatacaaaaagccaagtatattgtttgccgccgtatatccagccattgctattgagccaaaggaattgactgatgactgaagcatggcatttgatatatttatgactgtgctctgtatgccggccggaattcccacctgaaatatctgaagcatatattccttatcaatcgcaagcttattaaagcagagcttatagctggtatctgctttgctcaaacaatataatacaagtacgctggaaacaaactgcgaaacaattgtaccgattgcaacacctgcaacatccagtttgcacactattacaaaaaacagattgagcagtgcattgatacagcctgaaataatcaaaaagataagaggtctctttgtatcgccgacagcacgcaaaatcgccgcaccatagttataaagcataaaaaacggcataccgcaaaaataaatcctcatataaatagtggaaagacctatgacatcatccggtgtacccatgatttccagcgcaccccttgcaaaaataacaccgaccacacccatcacaataccacttatgagtgcaatcataatagaggtgtgcaccgtcttagacatctcctcatccttgcctgccgcataaaatctggcagcgagcacattcgcaccaagcgatatacccataaacaaattgacaaacacattgataagtgccgtagtagaaccaacagccgccagtgatttacttccactaaactgtcccacgacaataatatccaccgcattaaacgctaactgtaaaatacccgaaatcataagcggcaacgcaaatgaaataagcttatccattattgaaccattcaccatatcaatttcatacttattattcttcacttatatctacctcttaaatatattctactcagattatctattttaccacgataaaatataaattcaagcgtaactatttaaaacaactgagaataaaaaagagagcctcttttaagaggctcgacttttgcataataattaattcacagagtgaggattttccgttcaacacactgccttcaccggagagtacacagtatgttccgaagaaaaaatatgaactgccacgggtttccaataggttaaatgaccacatagacctgcaaactgccatagcctatccataaaaaatcccgtggctgacttcatattttatctgaggaatactactgtgtgctacaccggtgcccacagcccacaaacggaaaatccgccctccttaataaattttccagcaaattgctaaatctacttctttgtgatgtaaccctgtgccttaagaagctctgcacaaagcactgctccacctgctgcaccacgtactgtgttgtgtgagagtccgacgaacttccagtcatagactgtatcctctctgagacgtccgacattgattcccataccatgctcataatccacatcaagtgcaacctgaggacgattatcctcttcacagtatctgatgaactgctttggtgcgcttggaagcccaagctcctgtggtactccgctgaacttctcgagtgcctcgatgagctgctcctttgtagggttctttttgaacttgacaaatacagctgctgtatgaccgtttaatacaggaacacggatacactggcatgtgataaccggtgactctgcaggaacaatctgtttcttctcatcatccacatatccccagagacgaagtggctctttctcggatttttcttcctctccaccgatgaatggaatgatgtttccaaccatctcaggccaatccttgaatgtctttccggcacctgagattgcctgatatgttgtagcaacaacctcatatggctcaaactctttccatgctgtaagaaccggagcatatgactggattgagcagtttggctttactgctacgaaacctctctttgtaccgagacgctccttctgatatttgataacctccatgtgctgtgggttgatttcaggtacaaccattggcacatcaggtgtccatctgtgggcactattgtttgaaactacaggagtctctgtctttgcgtagtcctcctcgatcttcttgatctcgtcctttgacatatcaacggctgagaatacgaagtcaacctgtgaagcaacctcttctacctcattgacgttctttacaatgattttcttaactgcctcaggcattggtgtgtccattttccatctatcaccaacggcatcctcgtatgtcttgcctgcacttcttgggctggctgcaattgttgttacctcaaaccatggatggttctctaaaagagaaataaatctctgtcctaccattcctgttccaccgaggatacctactttaagcttttcactcattactctaatctccctatcttctagattttcttcgaccatgtcatacactatactttgacattaaaaccaggtcatgtccgtccgtcgcgtacaactgtctttataggaaatatattacttgaaactctaatgaaaaacaaggaaaaaactatattaaattaataatttttctcactgttttttataaaatatgcacaaaaactacacttcatcctgccaatttgacttcatatactcgtcgtaaacggcaattaccttgtccattgatgtctttgatggcgctccaactgtacaccttgtgctgacacaggtctccattgaaatggcatcaaatacatcctcctcaaataccggagagatagccttgagctcgtcgatgctcatatcgtcgattgcaatgcccttgtcgatgcagtaaagcactattcttcctacaatgccgtgtgcatctctgaacggtacaccctttttaacgagataatcagctgcatctgtggcatttgtaaagccattgtttgcactctttctcatcacgtccttgttaaacttcattgtatcaatcattcctgtaaaaagtgcgatacatccctttgcagtgtcgaatgcatcaaatgccagctccttatcctcctgcatatccttgttgtacgcaagcggaatacccttcatagtggtgagaagcgacatgagtgcaccgtatacacggcctgtctttcctctgacaagctctgctatatcaggatttttcttctgtggcatgattgagcttcctgtgctgtacgcatcgtcaatctcaacaaactggtactcgtttgaattccatatgataatttcctcagaaaaacgtgacagatgcatcatgatagttgaaagagccgataaaaactcaatcagataatctctgtctgacacaccatccatactgttaagtgtcggtccgtaaaaatccagaagctgtgctgtatagtccctatcaagcggatatgtagtgcctgcgagtgctcctgagccaagcggacaatagttcattctcttatatatatcgcacagtcttgatctgtctctcttaaacatctcaaaatatgcgcccatatggtgagccagagtgattggctgggccttctgcagatgtgtaaagcccggcatgatagtctgtgtgttttccttcataatcttaaggataacagctaaaagctccttaagctcattatcagtctccttcactgtctttctggtgaaaagacgcatgtcaagagctacctggtcgtttctgcttcggcctgtgtgaagcttctttcctgtgtcaccaagcctgtctatgagtgtagcctcaacgaagctgtggatatcctcatactttgagctgatttcaagctcccctgactctacctccttaagtatctgctttaggcaagccactatatcgttgctctctgcctgtgagatgatgccctgctttccaagcatcgtgacatgggcgatgctgccctctatatcctctttataaaacttctgatcaaatgaaatggacgcattgaaattgtaaacgagctgatctgtctcctttgtgaaacgtcctccccataactgtgccatgagattcctccttgattattaaatgatgatttattttcatgtatcacaacgtattgtataaaaataagatgtgataccgccgcctgctctaaacagccgctttactgtgctaaattatataataatttttgctgtcacgcaaccacattttcaaccacgtgctgcaatctctctgtcacgctgctccttggaaaatacacagccgcagtagtactgtctgtacatatcatactgctttgatatctccgtggactttttatagccctctttcttcttaaaatcagagaaaagatatcgcactccatattggctctctaagtcttttcctatctcattgagcttttcggcattcttcaacgggcttatggaaagtgtcgtagtaaaaaaatcaaagccatgctcccttgcatactgtgcactctcctcaagacgcagcctgtagcacttaaagcacctctccccgccctcaggcacagcctccatgccgcgtgccatatcgtaaaagcgcctggtgtcgtacacaccctccacaaagtgaaccggatttttcaccggaaactcatctataaagcgcttctgctcctgtactctcatgtgatattcctctggcggataaatgtttggattgtaataaaacacagtcacatcaaaatactccgagagagtctgtatgcaatacgtgctgcacggtccacagcagctatggagcaaaagacgtggagtgcagttattgtccatgcaattttcttttattaaatcttccattaatttttgatagttaattttatttgccatattatattatttctttctcaaaattcaaaaatttttgacatatccccaaatattatttcaggtaactattctgcatatttactattctgattaattactatttctgatataagctgcataatacgaacaagggccggaagtctcctcccggcccggctcatactaatcctcttcttcatatccgaacattagtctaaaaatcttttttcctgtttcagtcttgaatatgtgcttgtatgccttgtcgattgcacggtttcccgcatcatcctcatacagatttacgaggaaatcagcctcaacgagtatctgataatcaagaccatctatattgtcatatgtgtgatggtgacctatgagaaaacatattctttcaactatgtaattctcaaagccaagctgtgagagcatcttctgggcgattatcggtccctcctgctcctgaagctttccatcgcacctgccatacttctcctccgctacacgtatgccgatatcgtgtgtgtaagccgctgcctcaagtataaaaagcgaggcatcatcaagctcctctcctataccgataagccttgcatagctgtgcaccttggtgaaatgctggattctctttggatcgccatcatagtaggcaatcatatccataaacaagtcgtctaactgttgtttactataactgtcactatccatttaatatatttttctcctgataatatgttaattagtctcattgccggctttgcaccgacaatgataacatactacaaagcgatcaatttttcaatatttttacacaaatatttcttattttttgaaatcactatgttgtttgtcacactgttatgtgggaacagtaacatcactactttgcatcacggaaaaatcccctgaatgcgaattctgacaaaggcttcttgtaaagcagctctcctatcaatatctcaagcgctccacctgcaaaaatagcaatatagcctagcaatgccaccaccgggagtccaagcttaaaaacagcattagaaaccggcacaaacgctgctcctgaaaacacagtaaaaacgcccataaacaaaaccatgaatacgataaagccaagtacataatacttatagcatatgcttgtgtacagatatactgtcaacagctcaacatcaagcgtaaaaagtgtgaagataagctgtttcttatctgctacggaattctgtatcagaatgactctttctattaccaaaaatgtgaaaacaacaagattgattaccgtgcttgacatcaccggaatgtatatctgcagcttctttttcagtgatgtggactggataagctctgacacatccatcgacatgatgagctgaaatgtgaacatcccgcacatcataaagtatacaccacctatgatggaagttcccttgctcattatatcggatgcaattccgattactgcaaagaatacaaacatgatcacattcaacttcagtttgtagccatatctcaataatttaaatcctaatttaatatctttcagcataatatttctccttttcaaatatacttccaatttaaaatgcctctacacatcaacatatgatctgcggatacgcaccatcatatgataatatgtcgctgctatcactcctacaagcaccactgctaacacaggtgcgataaaccacattctcccgccatagatcaaaacagctatactacctgcaattgccgggaagataactataagcgccagcagataaatatacattcccatatccatgtatctgaatatatttaatgagccaaccgaaacaattgaagatatcataataatgtcaaatatcgaccagatattaactccaaatttaataaatggtattgaagcaatgagtattgtaattccaatacgcagcggtcttacaagtatatccacaagaactgcattctcaaagtatcttactccgttaaaacctgtctttaaaaaatgcatgccaaatgcattcttcttgcacatacagccaaagcagaaatagtcctgcaccacctcgcacatcatataaaaatcataaacaattactataactcctatccatgcccagattgttttcgaacaggcaattagcattgatgtaaaaattgctaaaaacggaatcagtatatttgttataagacgatacttgagattagtcataacacggtaatccctgatgtatgttagaacttcattctttgctttgttatcttttttattaattgttctttcagtatcatgttcctgtgaaaccattttttcattcatacttcctgacttactttccataacaccttacctcgcactagcgcatcacaatctttgtgttatttttcatgaccgcaacgcttatctggtaaagtgtcggaatctcctttgtcacattaagtcctgcaagcttatctatgttttccgccaagcatatgccctcaaagccgtacgggtttttggtcattgaataaagcaccttaccggcagcctctgtatctgctgcatcgcctttaatcaggatatatttttccttcaaatcctcaacaaagccctgctccacaatctgtccgttttccattataatggcataatcggtgatattttccatatctgaaatgttgtgcgtagagaaaaatacgctgcgctttccgttgccctcatggatatactcgccaatcatctggcacagcttatctctcataagcggatcaagcggcgatgccggctcatccagcaaaagaatgtctgtctttcgcgccatgacacctgccagcatgagcttcatcttcataccatccgaaaatgaactgttagctttcttcatatcaatgctgccatgtgaaaatattgcaagttcctcacaatatctgtgaaaatcatctgctgaaaaatcatcaaacatcagcttgctgatttcctcgatatccttaactgtccactgtggcagatagtatttgcccggtcctgtgtagcctatgcggtttttaatatctcccgagttttccttctgtttatcagaatactgtccgaaataagtgatttcacctttatagtcaagcctgattcctgctaatatatttaaaagtgttgtctttcctgctccattttctccgattaaggctgtggcaaagccctgtggtattgcgaaattctccacatccagtgtaaaatttttaagtttctttgtgatttttgctgcctcaattgcattctttgttgtcattttcatttctccttattcattttcatatcattatttatccacctcaagcaacgcctcaagcattcccttaagctcgtcgtttgagattccggccacctcagccgcggctatcgcgtctgtcagcgattcctccaccttacgcaggtgctgttcctttatcatctcactgtcctgtgcattgacataaaagcccttgccctgcgccgctgtgatgagtccctcatctgcaagctgctcataagccttcatcgtggttatcacactgattttcaagtcctttgccagccctcttatagacggaaggaactccccctgctcatacctgccggccaaaatatctgtcttgaagctgtccgctatctgctgatagatgggcactcctgaattttgcatcagcttcatatgctacctccgtactgtatttattaactgttcatgtgttatatatacactatatacattttaatgtcaatacctttctataattatctctctaaagatttcacctcaaaattttgatttgacatacactcttatatctgatactataatatagcttgccgatatggctcagtaggtagagcgacgcattcgtaatgcgtaggccaccggttcgatcccggttatcggcttcacataaaaaagcacctcattcaaaactgaatgaggtgttttttatagatttatttttttcccatttttctcaatttatcttttgctctatctattgtctttgtatgatccgcaataggtttctctgatttgcttaacattttctccgctttttttcctgatataaccataataggactttgtgaattattgtacatagtttttcctcctaatccaaatcagtcaatattgattctacatctctaaacataaacttacaatctccggcataatcagaatgtaatgcccttacatcagataatgtaggaattaccgcttctgcatcattctccatagtttcaaaccccatatttctatatgcattaattactttatcattataataaccgcaccatataaaagaagcaacaaaaattccccttgacatttataaaaaatatattaaaattatctcgttggtttatttttagtaaacaaaaaatctattattaaacctacagtaaatataacataaaatgtattagaaaaggaagtaaacatggatatcggacatcgtatgaaggagcttcgtatccagtacggacttacccagcaggagcttgctgacagggctgagctgacgaagggatttatctcccagcttgagcgaaatcagaattcaccgtcagtcggcaccctgcttgatatcatccagtgcctgggtatgacaccggcggagttttttacggattcggaacctgagcagattgtatacaaggcaaacgactatttcgagaaaattgacgaggaaaaaaacagcagggtggaatggatcattccaaacgcacagacccgctccatggagcctgtcaggctcactcttcatccgggtggcagttctgaaatatatctgcctcaggagtgtgaggagtttggatatgtgataaagggtaccgtgaagctttgctatggtggcaaagtacacaccgtaaaggccggtgagtccttttattttaaagccggtaagaagcattttattgaaaataagtcttcaaaggatgccatgctcatatgggtcagcaatcctccaagcttctgacgcttcccctgcagaagctcttttataggtctgtaattactgccggccgcatttttagtgtgtacagcaacaaattataaacatacaggtcctaccagtactataattacatgagaaaggtttacaccatgggaaagaaattaattgattttatcgatatcacaaagtcatacaacggcaatgttgtactcgacgatttaaatctatacatcagggagaatgagtttctgacgctgcttggaccatcaggctgcggaaagaccaccacacttcgcatgctcggtggctttgagacaccggacaagggaaaaatcatgtttgattcaaaggacatcacaaatgtgcctgcaaacgagagaaatctgaacactgttttccagaaatactctcttttccctcatatgacaatagctgaaaacatcgcgtttggtcttaaaataaagaaaaaaagcaaggcttacatagatgacaaaataaagtatgcattaaagctcgtcaatctcgacggctttgaaaaccgctctgtggattctcttagcggaggccagcagcagcgtatcgctattgcaagagctattgtaaacgagcctaaggtactgctgttagacgagccgcttggcgctctcgacttaaagctgcgccagagcatgcagtatgagcttatccgcttcaaaaatgagctcggtatcaccttcgtctacgtcacacacgaccaggaggaggcgcttacaatgtctgacaccatcgtagtcatgaatcagggctatatccagcagattggcacaccagaggacatttacaatgagcctgaaaatgcctttgtcgctgactttatcgggcacagtaatatcatcgacggtgttatgataaaggataagcttgtcgagatactcggtgtaaagatgccttgtgtggacgagggctttggtgagaacacgcctgtagatatagtcatccgcccggaggatgtggagctggtgcctgcggaggacggctacatgcagggcgatgtcgtgtcaaatatcttcaagggagtgcactatgagcttgaggtaaaggctaacggctacgactggatggtgcacaccaccaaatatgtagaggtcggcagtcatgtgggtatcaaggtgattccatttaatatccaggtaatgcacaagcctgagtcctcagatgaaaaggcggtggagatagatgtctaaaataaagaaacagctgctcgcagggccgtacctcatatggattatcggatttatcatacttccgcttttcatgattgtgtactatgcatttaagagctctgacggaggcttcacatttgaatatgtggctgcaatagcacagcacaccaatatcaaggcactgcttttatccctacggcttggaatcatatgcaccataatatgcctggtgctgtcctatccgcttgcgatgattttaaacggcttaaagattaaaaaccaaagctttgtagtatttgttttcatgcttcctatgtggatgaactttatgcttcgaatactcgcatggaagcagcttttgtccaaaaacggtgtcatcaactcgatactcaccactctcggactgccgggcttcaacatcatgaatacctccggagcagtcgtgcttggcatggtctatgactttctgccattcatgctgctgcctatatacaactccatgaccagaatcaaaaacgactggattgaggcggctcttgacctcggtgcaaacaaagtcacaatacttttcaagattatactgccacttacagtttcaggtgtcataagcggaatcgtaatggttttcgtgccatcactcacatcctttgccatctcacagatactcggtggcggcaaggtcctgctcatcggaaatatcatagaacaggatttcgtccatggctcgcagtggggcgcaggaagcggtctctcactcgtgctcatggtatttgtattaatcagcatggcactcgtcaatctgtttgataaggaaggagaccagagcgcattatggtaaaaaaaatagcatcaagggtatatatgggactgatttttttgtttctgtatctacctatcgttgtattaatagtactctccttcaacaactccaaatccaaggttaaatggggaggcttcacgctcgactggtacataaagtgctttcagagtgagcggattatgtcggcattttctacaacactgcagattacgctgcttgcagctgtgatttctacaataataggaactctcgcagccatgggtataagcgccatgaagaaacgtaaccagacaatctatctgggcgctacaaacatcccgatgctcaatgcagatatcgtgaccggtatctcaatgatgcttttgtttgtaaaattcatgaatctgggctttgtgacagtgcttatcgcacacatcacgttcaatatcccttatgtgatactcaatgtgcttccaaagctcaagcaaaccaacaaatacacctatgaggccgcacttgacctgggcgcatcacctctatatgcatttttcaaggtcacctggcctgaaataagccccggagtgttctccggctttatgatggcggtcacaatgtcactcgatgacttctccatcacctactttacgaagggtgcaggagtaaacacactctcaaccatgctctacacagagctaaaaaagggtgtaaagccggagctgtatgctctgtcaaccatacttttcttcacagtgctgctgcttttggttgtggtaaacatcaactcaaaccagatacctgtcagctcatcaaagaagcctgcaagggctaaaaagctgcgcatcgtaaagcgtagtgtgagcatcgcaattgttgcagtactcgtaatcggctgcttttcggtatttaccataagcgccggaggcacgaacaatgacaattccataacagtgctaaactacggtaaatacatcgatgaatccgtaatcgacagcttcgagcaggaaaccggaatcaccattaaatacgaggaatacgaggagcctgaggagatgtacacaaagtacaagtccggtgccatcgattacgatgtcatctgcacctctgactacatcatcgagaagctcataagtgagggtgaggtcaacaagatagactacagctcaatgccaaactatcaaaatgtaaatcaggatataatcgacatgtccgcatcctttgacccgacacatgagtatactgtgccttatttctacggcacactcggcatactatacaataaaaagatggctgatgcatcagacctaaatacctgggactgcctgtggaacggcaaatacaaggacaacatgattatgattaattctgtccgtgatgcctttactcccgcccttcgcacacttggctactcgataaacgagacagacacagcaaagctcgatgaagcatttgatatactgaacaaacaaagcagtgatgtgctcgcctactacgtggatgagacctgtgatgagatggttgctgaaaatgcggcaatcgcagtgtgctactccggtgaggcagctgccgccatggctgaaaatgacaacctggactatatcgtaccaaaagagggctcaaacctctggattgactcatggttcattccaaagacatgcaagaataaagagggtgcacaggaatttttgaactatatctgcggtgatgagcctgcacagctcaactttgaatatgtatactatgcatcacctatccagtctgtcatcgaaaaccaggatgcagaaacgaaggaaaatgaggcgattaatcctccttccgatatgctcaaaaactgtgaagtatacagagctttaaatgatgatgacgcaactctttacaatacactgtggcagaggctcaaatcggattaaaaatggattacacagctatattttgtatgatatcacaaaaatgaagtctaaaaattgtacaaaaatacatattgcaaacttaaacaaacaatgatagagtaaaacccacgaagcgccctgcttcgtgggttttacttttccacgagatccgatatttttatgctccgcaaggagattcatgaaatacacggagtttttacatactatagaaacagaaataaccgcaagacttgacaatgatttcaagcttaccatccatcctgtcaaaaagaacaacgggatgatctacgacggattggtgattatcaatcccaaattcaatatagcaccgactatttatctcaatccttactaccattggtatcttgatggtgtatccattgattctattctcgatgcaattttatccacctacaatgattttaagccaactgaagattttgacataagcttctgtgatgatttttccaaggtaaaggagaaaataattttccagctcataagctacgacaaaaaccaaaagcagctaaaggacgtgccctatatcaaatatctggattttgccatcatatttgaagtatatgtaggagcgcagctgcctgaatttggcaccattacagtcacagatgcgcttctgtcacgctggggcatagatacagaaacactaatccgcgcctcaatgcaaaataccccaaggatacttccatgctcaataatcaacatggcagagtttcttgccaaaaaatgtccgggctatgccaatcagatgcgcgcagtctgtgattttgacagcctgcctatgtatatccttacaaacagcaggcagacaaacggtgcatccgccatactctacccgggtgtgctaagctcgctggcaaaaaagctcggcggcaatatgctgctcataccaagcagtatccatgagtttctggtaatgccgctggatagcgatatagatgtctgcaacctaagcgaattcatctgtgaggtaaactctacagaggtacgcgacgaggaagtactcggcgagaggtactacatatacgatagtaaaacagacactgtctactgataataatataacccgataacacaaaataccggatatcatatcatagatatgtatccggtattttactttctaagaacatagtttgaaattcatgaaagttatttggcctgttatttgcagaatgatgtactagttgccaagcagcatgtcgtaaagcttctcatactctttcgcagatgccttccatgagaaatcatgcctcatggcgcgctgcatcatctcctgccatctgtccttatggttttcaaacacatcaagagcatatttgataacatgcagcatatcatgcgcattataattggcaaaggaaaagccatcgcccgtattctcgtactcattgtacggcactacagtgtccttaagaccaccggtctccctgactataggcagcgtaccatatcgcatagacatgagctggctcaagccgcacggctcaaaaagagacggcatgagaaatgcgtcacagcctgcatatatctcatgtgcatttttctccgagtagccgatatatactccaagcttctgcggatacctgccatggaaataattaaacatctcctcgtactgctgctctcctgtgccctgcactataaactgtacattcatggtagaaagcatctcctccatcacatatgccaccagatcaaagcccttctgatttgtcagacgcgaaactattccaatcagcatgacatccttatccacagccagaccatacttctcctgcagctgacgcttattaacgacctttccactcaattctcttacagaaaaatgcttatccagatatgtatccttcataggattaaagacctcataatctatgccgtttacaatgcctctcaaatgcctgcgccgctcaagcatcaggccatccaggccctctccgccctctggtgtacagatttcatctgcatatgtcggactgacagtcgtaatctcatctgcatatactatgccgccctttaaataattagcctcaccatagaactccagctcccctgaattaaaaatatgctccggaagtcctgtaacatcagccacctctttaatcttccatcgcccttgaaacttcatattgtgaatggtaaagactgtcttgataccggcatagaaattgtctgagccgtatactgtctttagaaaaaccggcaagagtcctgtctgccagtcattacaatgtatcacatccggggcaaaatctataaccggcaaagcctcaagcaccgcctttgaaaagaaagcaaacttctccacatcctcgtatatattgttgtatggcctatctcctgcaaagtaaaactcattgtccacaaaataatatgtcacaccatcatactgcgatataaaaatccccacatactgcctgcgccagttgagattgacataaaaatgacagacgaacttaagctgtggcagtaatttatcatccatacatttgtacttcggaagtataactctcacgtcatatctgtccttgtcaaaatattttggtaaagatcccactacgtcagcaagtccacctgtcttcatataaggtattgcctctgatgcggccattaatattttaattttgtccatgctgaaacctcccccagattacagttatttaaacaacgattaatctgataaaaaatatagtatacatcctgaaaccaatagaatgtatactatattatatcacgcgggagtacattttgcctagtaaatttatcaaaatgtggttttatttgtctataatgacgatttttacatcccaagacgtattttgtctgtaatcagggcaataaactccgaattggtaggcttgcccttaccatagtttacagtgtatccaaacatggcgtctatcgtatccatcctgcctctgctccatgccacctcgatagcatgccttatggctctctccaccctgcttgaggtagtcttgtacttctttgcaatagtgggatacaaaagctttgtgatagagctaagcatctccatatcctcaacacacatcactatcgcagtcctcagatactgatatccctttatatgagccggaacacctatctcatgaatgatatccgtcacctgtgtctcaagggattttttctccatatatgtatcatcaagtggctcagtgtcaccggatgctctctttacatacacaagtatcacatcagaaccggcattaccgtttatcatgctgtatgcttcatcactacttcttgctgttcctataaactccatgccctttaataaactctgcatatttttcttttcgtctgctactgcgacatttaaagtgctcatcaaactctcctatgccgccaattactgtcatgtcaaaacaaattttatgtttttatgataacacattttgtcgaattttgtcgagagcgtattttttttaaattttatgtaaccattcagccccacgcatattcgcaaaaccgcacgatacccgtgctttctctattcttcaaactgagagttatacagctctgcataaaatccgttctttgcaagaagctcatcatgtgtaccctgctcgataatgtctccgtccttcatgacaagaatcatatctgcattcttgatagtagacagcctgtgggcgatgacaaagcttgttctgcccctcatcagattgtcaagtgccttctggatacggatttctgtacgtgtatcgacagaggatgtggcctcatcaaggataaggattggattgtctgcaaggatagctcttgctattgtcaaaagctgcttttgtccctgtgacacattggaagcatcctcattgagctccatatcgtagccacccggcaatgtctggataaagtgatgcgcatgtgctgcctttgctgccgcgatgacctcctcatctgtggcatccagacggccgtagcggatattttccataatggtgcccttaaagagccatgtgtcctgcaataccatgccgaatgcatctcgcagatcggctctgttgtaatccctgatatcatgtccgtctacaagaatggcgcctgagcttacatcataaaatctcataagaagcttgaccatggtagtctttcccgctcctgtcggtccaacgatagcaacctgctgtcccggctttacatttgcagaaaaatcattgatgatgatctggtcaggattataaccaaagtgtacatgcgaaaactctacacttccctcgatatggtctggctttacaggattttccactgttatatcctcttcctcctcctcgaggaactcaaatacacgctcggatgcagccgccatcgactgaagctggtttgccacctgcgctatctgctggataggctgtgtgaaattcttcacatactgtataaaggcctggatatcaccgattgtgatgacattctttatggcaagtatacctcctgagatggctactcccgcgtatcctaagtttcctacaaactgcatgataggcatcataagtcctgagagaaactgcgatttccaagcggatttgtagagcacattgttggcctccttaaaggtctttacagtctctgcctctttattatatgcctttatgacaaggtggcctccgtacacctcctcgacctgtccgtttatgtgtcccagatactcctgctgctgtctgaagtatttctgtgaatgctttatgacaaacgaaataagtatcatcgaaacaggcaggataacgagtgaaatcagcgtcatgagcggtgaaatagacagcatcatgaccagtgtacctaccaaagtggcaacagatgtaataatctgtgtaatactctggttcaagctctgtccaagtgtgtccacatcgtttgtgatacgcgaaagtacctcaccgtatgtccttgactcgaaatacttcatcggcatacggttgattttgctcgtgatgtccttacgcatcctatagcaggtcttctgcgtgatgcctgtcatgataagcccctggacaaacataaagatggcactcaccacatataaagccagcgtaaacaaaagaacctttgcaatataatcaaaatctatgccgcctgttcccgcaatcttgttcatgagtccctcggcaagcgcagtggtggctttacccatgaccttcggtcctgcaacggagaagacagtcgaaactgctgcaaaaatcataactgcaatgatagcagcccagtatctgccgagatactttatgagtttctttgtagagcccttgaaatccctggccttttctgtgaccattccggggccacgtcccattggtcctcttggcctcttaggaggcatcttaaactgttcgttattattctcactcatcttacatgccctcctttttgttatcatcaattccaagttccttggctgaaagctgtgactgtgcaatctgcatatatacatcgcaatttttaagaagctcctcgtgggtgccttttcctacgattttaccgtcatcgagcacgagaatctggtcagcatgaataatcgtgctgatacgctgtgccacgataatgacggaagcattctctgtaacctctgctaaagctgcacgcagacgcgcatcagtcttcatatcgagtgctgaaaagctgtcatcaaacacatagatatgaggatcctttgcgatagctcttgctatggcaagcctctgcttctgacctcctgacacgttggagccgccctgtgcgattgagctttcatacctgtcattctttgtctcgataaactcagaagcctgtgcgatatccgcagccttttttatctgctcatcactcgcgtctgccttaccaaagcgcaggtttgaggcgatggttcccgagaaaagaatacccttctgcggaacaaagcctattgactcgcgaagctcgcttagtgtgtagtctctgatatcgtgtccatcaagctctattgagcctcccgtcacgtcgtaaaaacgcggaatcaggtttacaagtgtagactttccacagccggtacttccgatgatagctgtgattttgcccggctccgccacaaaatcaatgtctgaaagcacatcctcctttgctcccggatatctgaaatccacatggttgaaacggataacacctctgtgatcagcctcagtaacaggctcttttggatcatttacagtgctgtttgtctttataacctcatcgatacgctctgccgcaacaccagctctcggaagcatgatggacatggctgaaagcatgaggaatgacataacaatcatcatggcatatgtaataaacgcagtcatggtacctacctgcatagaacccttgtctattctgcctgctgcaacccacacgataccaagtgtgatgcagtacatgatcatggacatacccggcatcataaaggtcatgacacggtttgtaaacagctgtgtgcgtgtaagctcacggttagcctcatcaaacctcttttcctcctccttctcacggccgaaagccctgataacggaaagacctgtaagaatctcacgagaaacaaggtttaccttgtctacaagactctgcataatcttgaactttggcatcgcaatgccaaccagtgtgaaaataaaaaccatgatggcagcaaccgcaatggcaatcacccactccatgccggatttggtctgtgccaccttgatgataccaccgataccaacgattggcgcgtaaagcaccatacgaagcatcatagtagtaaccatctgaatctgctgtatatcattcgtgcttctagtaatcagtgatgccgtagagaatttgttaatctcggcatttgaaaaacctacaacctttgaaaaggtcttctccctcaaatccctgccgacagcggcaccgacctttgaagccgcaaaacctacaacacatgctgctataagcataatagctgcaaaggctgccatcttggcgcctgccttccacagataagcaacctgattggcatccacgtcgattcctgcattctcatcacactttgtcgcaaaagttacacccatggactttaaagtagctgaacccaccgcatcgattttttcctgcaccttgcttcttatctgctttatcatgttatcatcgagcgctactccctgcgggatagccgatgcatccacatccatctgctcacccgactgaaaagcctgatatgccatgacaagaggaaccaaaagctcctcatccagcttatcaagtgtgtccgaatcagctgtcagcttgtattttgccacactgtcatcagattttgaagcatcctctgcctcataacagtccgtaaatttttctttctcgtcagacagcataaatgtctgtgccatctgataatcctccgatgtaatctcctttggcaggatatgctcaatgccatgatcctggatacccacatcaatgatgtcagatgtgtacgcaggcaaagccagatcacaataagcctgagcaatgagaaaaacaaaaattaatatgatccatcgccagtatggaatcaggtttttgaaaattttactcataaacgtttcctttctttccggttaatttatcccccatccacgaatgcaaaaaaatatccgcaatcgtgcgcatactatttattttatcaataagcgtggataattcaataaagaaagtataaagaaacagtaaaaaaacagagactatataaatggtttatataagtctctgtttgataaattgtgcttaatcgaaaagtatgtgatagctagaagcctttgaaaactaatccaaatctgcaagacctacacgctgtatctggaatgtcttgtatgcctttgctgttgtagtttctttatcaccaccgctcacctgtgactggtaaatcttactatatcctacggcataaatctttatagaattagctccctccgttaaaacactcaatggtacctttaccttatatgtcttgttattttcaaagaagtcccttggatccttatttaattgactgttttctttactgttatttatctgttcattttctgttccgtcattattcagtgtatagatatcccagtccaccttctttaagtaaatcttatcatttccggtgccaatcgtttcatcttttggatttttttgcggatcctcgatataaaagtccatataaacaacagttttatcatcaatctgattacgtacgaggtttgaatcctttaccgtaaaataaacatcctgcgtactatctgcaccatctaatctggcatctgctttattagctgcatcttcttcaatggcatcatcaatagttgcatataatgtagatatgtcatttgaatcggtatcagcattctccttaagataaattgacggctcatgaaccgctgcactatatgcagcaatcatagtgtttatataaagtttcaattcatcctcattatttgagaaatcggagtgtcctacacctgagtatgttacatttcccattgtgtaaatataataattatttcttacatcctttggagactgctcataaattccctggtttgacaaggtataccatacaacaatatcactctcaccatcaccatcagcatcctgattcatatccagctggtagtactgcttatgagtggtagctatatttatttcgtcagcaatcttaaaaggatatgtggtaatctgtcctgaattaaccttgactgccttattagtcttagcttcaacatcataattatcaagccctgaatacagcctgtactcgccatgatcactaccattatctttccactgatactgatttaaatccgcataagtaaatccctgattctgtctgacaataactgtattaccagattttggctcatatgcaatatcagtattattctttttggcagtctgtacagctttatcaaaatcctcatcagtactctgtaatatattgcccttctttaaatactcatttgacaagattccatacctgtccagtccgacagtatcacgaattatagagttaaacttatatccccagacattattatatttattatcatttttattattacaaaatgacgttgtatcatgagcaaacaatactggttttcctgactggatatatgcttttattttatcgagatgattatttgtattatcaatatcataacaatcaccaaatccaatcacaagcatatcgtatgtctgcagcttatcacatacctcatccattttaggtacgttgtcataacgaactgtttctatatccaggtcaaaatccttcacttgactaagtaatttattaaactttgtattgctatcattcttctgcgcctgcatatcaaaatttcccctaaagccctcattatgctccaactttgaattaatctgaagaatcttgacttttgtaggactaccttttgaatttttgacatacacatatccggatttctgatcatatctgtagctatttgtagcctgacttacacgaagctgccaaggcataactcctacatagccattcggcaaatcatagaccagtttataattataattgcctgcattcagactatacatatatttaccattatcacccattaccggattcacaatagtgccatcacaatatatttttatcttatttgcatctattccttcattggttgtcgaaaacttaccatcggaattcgaatccaaaaacagctgtgcattaaaacttgctttggaatcagcaccgcctgcattgtttattgaaaattccaatgtaacctgattattactaatctcaacataatctgtatctttaactttttcctgctccttgagtaatatttcaggtttttcagtagtcaggtaggtaacaagctcagctgtctcatttgactgttttcttaaagctcccttgctgtccactttaagaacattgtctttatcttttgcataacataaaagagtaaaaacatttgaacagttatcaatgtaatcctcattaattccactttcatacttgctatcattgctgaaaaagccatctgaaaagacgacaggaaagcccgcctttatataatcctccaattctgaaaccttctgcttagtaatatcattgcctgaacctctatatgtgtttggagcagttaaataatcagcattatttccatttcctcttaatgtaagctgagtattaagcgcctctccattatttatataatcagtatccagcaatccagcatgaccattcttgagcatatcatatccccaataatttaccacatctttcggatttataacaacaatatcaccaacatttgagtatttaagcccatccatcttccaatcattatatactgtatgaccatctctataattcagattatcggctacgagtcccatatatatcatatcataattattgagatcctctattcttccaataaattctgcactcgtaacccttgttattgtaaccttttttttctccgggcatcttgatccaagccaattttttagcttatcataatttaaagcgtcagactcattttttacagttccgggctctatatccagtatgttcagactatctgtcggatttataatgtctcttttatcggcatacgatatgatatagcttaaaactatcgcctttgaaatctccttgtcatagtatgcatactcgtcctttccaagagtatcattttcttttttcctgcttgtattctctgagttgatatactctgctatctcgtcaaaattttcatttttagctgcttcgacaaattgagtttcatcttcatttgcaataaatgcagaagcaaaatcatctcttaaaacaaatggcacatccgtactaggattatagtttcgtggaatgacatattcgttgccaattacaaaaccttttgtatgggttttactgtcaactttataatactttatgtcattattccaattaataaaattatcagctgagtccttagtaaaattcagcgagctgaaattgttacagcttaaaagacctgcaagctttttaatattacttgagtaatctgcaggtgaagaagcccacacaataccattatccactataacaggcatcattataccactctggtgtacacgctggactatctgctttaccttatcccatgtaatgtcattaccggtattatattttgctgcatcgtctcctaaatcatttgaaaggacggactttgagccggaaagatagagtaaatcaattgttgacacatctatctgctcaagctccttgggtgtgaccgtttttaccttgaaggtcatattggcagtcttatcatcatcgcctgtcttgccctcctgattgaacacacctgttctgaaccagttattgttcttgaaaccacccttataatatatgtgtgtggtatttacaggataatcaagcgagccgtttttatcagcctccattatatagtcaccttttcccttacccacataggtatatgtctggctgtccttaactatatcaaaatatccgtctgtatcagtgaggattacctttcctgtgttacctgccggctgattgtccggtgtgccatcatctatcttctcgtatggattctgtgagtcaagcactgctccatactcgccggtctcatcgtaattaaactcaataggtacctcagtgtccacctcgtagtaggtctcgtcatcagtgattttatctgcaggcacatactccatctcaaccgtacagtatgtatacttctcataatccggcttactgccatcaggcaaacctgccatccggtcagctcttgcaacaaattcatatggtgatgtgatatctgaattgtcaatcctgtaaatatatgcctttgggtcatattttgctatgttttgcatgccctcagcagaaccaatggcatatgcgctctttatagaataaaccacatgcttctcaacggtatcgtcacctgtgcctgtatctgtcgtattgtctgtgctgctatcgatgttaccatctgtaccgctgtctgtatttccatcagctttctgtgaattatcagacggtaccagatactgggtatttgtcatgccatccggcaatttgactgcagtaaaagcaacactgtagtagcctctttttccgggtgccttaatttgattgccattttcagtctctgtatttgagccatcttctgtctcatcctcgccctgcatgaaaacataatggtcaacattttgtctgtaatgacctgtaggcagtccctcctcatttactgcaagctggtaagcggtattgaacttataatctccttctgcctgctctgtcatcttataaccggtggtacccttgtttattctgtccatatctacaagggcaagctctgtccagtcatcgccctgactgacatagctctcctcatacggctcatagtaaagaggctttgtgttatcctttttctcggtagtaataggtgcaagctttgttttcagaccttccatataggcagacctgttttttacaccggcaccatctttatcagacatctttgacagtgttccaaaccaatcgtcaggctcctgaccgtcaatcagatagccaatggatgccattttcttgtcaggcaccacctcaactatattgaagggcttgtccttgccatgtgagctgactatatccgatattccattgaacgctacatttgcatcgacctttgtaaggctgtcattcagcacaaaagctgccacaacgagacatcctgtaagtgtgagcgatattggaaccactattttttttcttaatttgctcattgcgattgctccttttgtaaaaaactactctgtttcttaatatgtataaaacgtaattgtatttgacttaaactccggcatatcctcaagtccaagccagacgctgatatttaatttctctccggtaagaaaatcatttccgagagtgatatgcatttctttattataacctaaaatataataattaagatagttcttatatttaggatcatctggcttaccttgtgctcctgtttctcctgcaatctcatttgaactaaacttaaatattccatcaggctcaccattgccctccggtccataaatcagcttgccatcatcgcccattctaaaggatatatctcccttgtgctcggttgcacctgttgagctgacactttctacctccatatgccatacaaaatccttaacctgatatttaccatttaatgaagaattttttaactcccattcatcaataaacaattgatgcgtctgtcctaaattgaaatgcttatctgcatcacaatgcagaatattgattggatgtgctacgtttacagttacctttgccgtcaatgacgtatcgtctttggatgttactgtgataacaaattgatctgtagtttcattatccataagttctacattatatacatcaccattagcattaaagtttccaccattttttgttccagaatgatcccacgttacattttttgaatcatactttccacccagaatcttatcagtaaactctaatttattctgatttttcttcatttcatagtataccgttccgttggttacatccttgcctttataatatatccttattccttcaggctctgccggtgccacatactccacatctgccccggtcggtaccttatttcgcatagtgaagttctgctttgatgtatacttcttgtcccctgctttaaagtccacgacaagtccgacagagttcttgctttctgcctcgcttaaatcaggtgtaaagcctgtgacattttctgccataagcgattccttgccctgaccatctgccttcaccgcacctgttgcaggatccagtgtatcctttcgcagatagattttgtgctctgatggtctgtatatgatattgtatgtacaatccttgttgtagataatcagcttgctgtcggatgatgtttcctcagatgatgcttcttcggatgacgcttcttccgctgatgcagttgcaacataaccggcctcaggggctgctgatgccacctccaccggcgctgccactgtagcaggctcatacttgacacccttttgcgcatcaattatcaggtctcctatctgattcatcgtaagctgtgcctcatactgtaaatctacgtcctttgaagcgtacttatactgcttcgtgctcgtaccgataaagcctgcaacagccagccccagtattcccattatcgccatgacaatgacaagctcaacaagtgtaaagccactgtttttcctattatttgatttgttcatgcgccttaaaagtttcatggttcatcttcctctccgatttcatcatacaaccttataacagccttgcgtcaaaataaaatattcatcattaaactatgtaaattactcacataccaccttgccggtctccttgtatatcgtgataaccttctcggtgctgtttttttgaatccagatacggctgcagcacttaccattggcatcaggcttttgtgcacctgagcttctgtcaaactgaagcactatactgtctgagccgttcaattgtgtcttgccggtataatcatcattcacggaataatatacatcaatcctgttctttccgattttgcttggatcagatactgtaccatttatagtcgtcttataatagtaggcaccatctgatgcatccttgtatatctcaagaactgcgctgtcctttcccatcgtggtgactcttgttttattaattatcgattcaatatttctggcacactgcttcacctcaacccccattaccgagcgaatggatatggttgccgcacctatgagtacgacagatatcgctatcactactataagctctaccagagagaaaccaccattattctttttttcttttacagacatattggattcctcccttgtatatatcgtcaaaatttgtcaaatataaatatttcgcagctgttttgcgccttagaagccgcttgttttctactccttggtccagttctggtatgtaatgagcgtagcataatctatttttgtatctgcctccttcttatttgaaaaagaagaaacattacccagatagttggcaccgtccatgaacacatcatacaggtgcagtgcatcgtctgcatcacttaccttttcaagaagcaatgccttaaataactcctgagtaccattatcaatctcgcactggtctttgtttacaattatcctgccctttgcaactatggtacctgtaaagtcagcattcagtgtcacatctcccgtagcaacaattatatccacattgtgtgatttgtcatttgcatcataggtgtagttaccgtttttgacaattgcctgatacgtttttccctgatactcagtctcaaatatatgtttattaccggaatttggcactattttcagcaaattggtattgttaactatatttgtaaaaagcgaaacacttgctgcatttgtcggtaaatccgcataattcgtcaaaagctttgaatttaatgcagtatatgtgcgctgtaaggcatctgactgtgcatccatgtctacaccatcagctatccccttcaaaaggcttaaattgctgccatcgtagatgctgtaattgccggcagtatagatgcttgcagcctcatttacctgtatgctgtcagtatagaacttagtgtatctattgagcttgtcactgtctgcaccaaaatagtcactgtaatactcagcagccttgttcgttggcagattgacataatagtatacaagtccatcatcactattatcagtagaaggaacaaagactttctttatacacttatcgattgtcctgccctccggcagatatgccgagagcgccttgcctgtctttgtgctgaccacattggcattaacttcagtatactttgtctgatcctgtccggttgcagtaatatccttgtactccttataggagagtggattcttgttgtaaagtgatttggcatccgcaccatctccatttgtgcctatacactcaggcggcacaaggtatgctatctggtcaccctttacagagattgactcacccatagccacattgctgttttgtgtacccacaccacttgagtttacaatagcctgtgtattgatatatgcagttcctgctaacataagctccctgatatttgacatatcaagagatgcctccctgccgtttatgataatagcagagctatcgcctgcgacaggattttccttatcatcgcctccgttgccaaagccgacgtacttcgcattgttattcttattattcttgccaagtgtgacctttgagcctgtaccctttaaggtcatgtcatctgccacatatgtcatgccatccagcttgaccgttgcaccatttacatttatgttgcttgtccacagctggcactgtgaatcaacagaaagtgtactattattgtgtacccccgccatgttcttttttatcgtagcagtatcttttccggcaaagtctcccacctctatatcgccctctgcaatcatatagctggtatcctttacgtcaagtgtggcattgtttggaataataacactcgtagtagaagttcctgtgtctgccgcattttcacagccggcatagagattgccggatagatttactttattaagtcctgatataatatccagtccttcatttccgacaagagaatatgtaaaaagctccggaactcctcccgatgctgtaaagctcatggatggaactcccagagaaatatctgtttctattattgatttaaatcccttttcatcggtatactctaccctgatgccattaatgactgcgcggctgttgtataccttgagcagtccatttccattttcatcggcatttaccgccttgaccacagcgtgtggctttgagttttcgtctgtgagcttactatccacatagtctttaagcttttcagttttatagtgcataccggtattgtcagactcaagacttccctttaagctctttaaatactcctgcgcaaatatactctgtctgccggcctcatttatgctgctgtcagagtaattctccataacctttgtatatcctgctgagtaagccttggaaatatctccctgcagaccggtacatatctgatccagcacaccctctgccgagtaaaagttgtctgtatttttttcgtccgtcaccttcatctggaggttcataagtgctatccacagcacagtcacagctaaaacagccactatagccattgcaactacaaccatcacaaaggaggcaccacggttatcattacgcttcataattaataccccatgcttccggtcatcgtaacaaccgggtctttatccttaaatatatcatccagtgaagccttgctctcgtatacagccaccttcacatcatacagcctttcagatgcattgctttttgtcagattctttatatcgacaattgcctttacatcattctgaattacattgttattaaagccatatatagcttgatcgggctgtagtggattatccggtgctcccatatttacattcagattggtggctatatgagtataagcatgacctgtacgatttcccggctcacttaccttcacatatgccttatatgtactctccttcgtgctcaactctgactgatccgatatagtcttttgctttacaatgtttaccgtgcagtccagcttgtccttattattgattataatgacatcgttgcaggtattgtaaagtgttcctgtagatgtgtaccatggattgtaaaacagatagacattccttagattatggttcacagtatctgaagaattatcataaatcaccatggtataatcatccttcagtgcactattcggatccggaaaagtctttcttactccattcttattgatagaatatgaatacgacaccgtaaccttggtagccttattactcgaagctccatacttttctatatctatggtgatagttcttttgatatcctgctgagtgatgccgcctacaccaggcatattattaaatgcatatataatatttgtagcagaatacttgtctgcactcatgcagtcaaaatttgcatccatggccgacatatccgctacctcgtccatgttgtactttttaaccttattgtccgactctgcgtccgattttgcatccactgtcacaagagcattgtatttctttgtgcctgactgcacaccagacatatagaaataatacttgtgcgcatccgactccctgaaattccaaagcgatgtatcgcttattttggctgatgcatcagtcttgtggatgcagctagtaatgacatcatccttgtttacaatctcagcactgatatcctcaagcctctttacattatcaaacttacccgacttcttaagaagctcacatgcactgcttccatctgatatattaaaaccgtccgacacatcaaagccctccgacggatagttaaactgatatgccagtgtcttcatggagttcttttcaataccctccataatgtttgtcgccagatgtgtagcattcatctcgttttttgccttcacattggtctttgtagctgtgacaaatgcattcaaaaaaggaagcacgattattgcgagaatagcaatcgacacaataatctccacaagtgttactcctcgatcatcgttttttagctttctcaaatctgcttcctcccctcttgtattttgttatctcataactcaataatctaacatttgatatttatcacttacggtctcaataacccgctaatctaataacctaatattataataatcagttagtttgttgtaccaaacagattatttgtaccatgtggtactgcaggtatgtatggtgcctcatatggcttatcaagtccatacaggaaatatgaatccacaagcatctcacctgtcagcttgcctgtcgaatcatcaaagctcacattgagcgtgctgatagttttcttctgtgatgaaccaatcacctctccaagcatagccttaagcccatgatactctgtcttgaatgccataactgtactgacatcataaagctgatagcctgtaaccgtagactttgcagagcctgttgatgtactgccatcagatgcactgccgtcgcctgtctgtgactgagagctgttgccatcagcggtctgagagctctgcgaattgtctgcattactgctatccgtggtactgctgtctgaactgcttcctgacgaagaatctgtaccggcttcacctgtcggattattcacatcaatagctgtcggtgagccgactgtaagctctgtaatatttgtattggtagatttctctatagcaaccgcatccatgatgccgttttcaatctgtaaatatgaagggaaattgtcatatacctgctgcatggcatcagacatatcctttgttttctttgtgtagtcatccgcctttgccgcaagtgctgaaagctgattgtactgtgatttcagattcatattttcgctcttgagcgaatccctcttattggactgtggaataaaaatcaaaaaatatgtcagtgctaaaatggcaacacccgctaatataataagtaactttttatctctcgttgacatcctaacaccccctactgatttgtactgtctgtatctgatgatgaattactatccgtctgtgactgtgatgacgcatcttttgatgtatcatctggctcactgcctgtgccatcccccgattcagaagcagcactgtcatcagcctttacatatgtgcaatctactgtgaactgaacctttgaagcaccggtctcatcaacctcctctgtaatggttgacacattggataccatgatactctcaaatgtacgaagctgtgcaattacatcagccgctatatccttgctgcccgtctttatggtcatcgaaacaccatcagtcgtaacagacatattcacaagcttggcctctgacggaagcttctgctccagctcatccacgaagcccgttatctcatcattcttgttggatgaggcgctctcaagaagcttagtccagtcatagtccttctttgtctggttgtacacatcatatatattctgtgcatatgacaaatcagaaacacgagctttaagcgtcatattgtctgaagttaaaacaagatttgaaaaaatgctgtatgccgtgataccaactgcaactaccacacacaagccaaaaatgagaagctgcactgcaaaagaaacaggcttttcggcttcctcccctgccggtacgggaagaggctttccatcaggaccaacaggtggttttccctgcatccctgcctgtgcgccgccggatggcatggcacctgcagctgttcctgccataatcggagcaccgattcccttgtttttcttactgtcaagtatatcaagcgggctcagtgaacatccgacacagttgaaatactctgccagctttgcctctgcgaggtttatgctctttgccacatgtataccgtcaaactgctgaagcggaaccaccttgacattcagctcattggtcaaaagctttgagagtccgctgaaatcagcacctaagccaatgaggaaaattctctcgataggagtatctgagtttctcgactgataatagtctataactcgtccgagactgcttatcagattggaaagtgaatatgatacattcaggcgaagcttcttaaagcgctcagaatcaatctcatgccccataggatccatgccgccgcccgccggctcatcaggtactgtgccatcaggccttattgcaaggcaggtctttctgcgtgccacatcaactgcatcggtaaatgacagatactctccaaaaagctcactatcctgaatcgcctcaatagcatcagcaagtccatggttgacattgcgctgcagctttaccatgcttccatccattacagtcagtgtggtagaaacctcatccaccttgacagtcaccttcacatctccgggaatctctcttctcatgagctgcttgatggcatttccactatagtcaagtgctacaagttgcagcctgcaatcagctgcaagagcaccatacgacaaaataagatcattaggcacagcaataaccgaaagacgtaatttcttttcttccggtctgtcaatcttctctataatctgatgtaccagcttgtactggctcaaatccaccggaaaataatctgatgcattcattgcaatcatttccttaagctgtttttccttaacaagtggaagctcaatatctctgcttgctatacgcgctgaatttaaaacaaaaacagcttttttggtggaaatcttcttttccttcagcttactgtataagatagaacgaaacatcccatccggctgtaccactccatcatcaatcatccccggcggtgtcggaaagccgaacatattgtaaatcttgggattttttgctttgtaatcaatctcaactactctggtaaggttctcccctatttcaataccgagtaccctatttgccataacctagtcctccgtgtttatctttgttttacactgtatacatctgtaaaacattcgtaactgctcagttacaaacattctatatatatatttcggtatatctgtgtcttctctgcttttgtctcactgctggtcgtactgcctgttttatattaagtacgctatattataacacgttttttaaaagcctgcgagtgtcaaatatgccgatatcattttctcaccccatagcatcgaaataaatattccggctgccaagtacggtcccatcgcaagcctgttgcctgcgtttgttactttcatacgaatcagatgtatcacggaaccgatgatgcatcctaagaaaaatgctaatgtaatattctgccagcctatcgcaagacctgcacatgccatgagcttgacgtctccgccacctatggctcttcctccacttacaagaagaaggagttcaaggaataaactgacgcaaaagaatcctatcacatattcagaccagttatcatggtctataaacacatgcaggattccaagcaccagtataaatatattgattccgaatggaatttcatatgttctccagtctatcacactcagaactatgagtgcagatgtaagaaagcagtagatgatactcgtaagttcaagtccatttactgcaaatactactatgtataatataccgtttaacgcctcaataatagggtattgaggtgatatctgttctttgcacttgcggcatctgccacgaagaaacagccagctgaaaaccggcaccatatcgtaccacgcgagctgatacccacatctcatgcagtgggacctttcggtcaccactgtctcatgctgcggtatgcggtagatacagacatttaggaagctgcctataactataccgaatgcaaatattaagatgtagatgggtatcagttctgtggtcatggttggtggtccttttagtaattattcagctatatctttttatttacttattgaaaatacttcattcatatccttcttaggattttttgtatttgtagttgcagtagcagttgttgaccacgcgcctgttcccggatctaatgtatatgttattgttggccatccactagactttaatgcagcacttgaagtagatggtgtgaccgtacctgagcttgcagtaattgtagtagttgcttttttgccactaattgcaatagttacagaagtaacattctcattatctgaaatatcagtttctaccgaagacttaagttgctgtacactctgcatatctgttgactgtctagacttctcaacatacttgataaactgtggagcaagtacacctacaagcactgccatgatggcgattacaacaataagctctacgagagagaaacctttgttgttcttctgtttctttcctaactttttaaatacattctttaccatagttcttttctccttttcattataacatggtttttgtgcaaagagctgtgccctatcagcatctctttggtttgtatgcgctcattgtaccataaatcaaagcataatgcaagttattttctagtacaatagcactattggcgcacaacttttttcgctttctttagcaatttcaaccaaatttcatccgttttattgcatttatatcatatttttcaataaaaattttctccagagctatactccgccacagcataaggggcttcatcccatgtgaccggctaacgcatacactctcgtaagagctacgctacactgccaagatactgtaggaattatgcttttagattttctatgcttgacgaaaccgtcgaaacgcgccgtccgtggcgcggttctccttgcccattactgctcacaccatcagtgtgaccagtaacgattacagcccattaaaagtgcctctacgaggcaggggctgtaatctgacaatagttgatttattggcgcatagcttgacagcgtggtgtcaagcttgcgtttgaacagcaacgatatattacatcccagtggcagttcatttctgtgtttcatgcgcataattcagcagtatctaagcagcttcgctattcgctcacccgaaagtatattcgtcagccgatcgtagagaatgaagccccatcctactgtcagcaaaagaggaagcaacctccgagttctcgcccaaagattgcttcctctaatttacatttcactacaatattagctcacaagccatttttttacagtttcctcatcaaaatccacacattcagctatatcttctattgagtgtccttttttctgaagttttaaagccgttacttttgcctgacgaattctgccttcttctcttcctaattctctgccttcatttttctgatcttcccacgccttgcacatatcaatcacctcttctttctcatctatgtctatattcgttcctgcaaacaggttgattgcctcgactgtctctctgtccacattgctaaacttctcgtcattctgcagcacttcctgcattttttccttatcataagcattctgtaatacctcgaaaagctgcctgattgaggttctgaatcctgtaaagtcggttatctccctcggagccagcaggttaatcctataatccggtatgaatggcagaagctcctcgtccacatcaccaaacatatctgacagcctccttggtccatcccattcctttgtcccgagatacactgtaatcgtaattactggaatcaacttatcctctttcgtaaatcccgagagaaattcatccgatgttgccgtatccttttcttttcggtgtttttttgctgtttcctttacctggttgccgtatgccatcacatcataaaacatgttttttaccggaatggcatagtgtatatccgactgattttctactcctatcagtacgacatatgatttgccggtatatttgatgctggcatttttgaagatgtccctcatcttctgcatcgctatggtctttttgtcaagccctagtgcggtcagaacctccgtggtatccctttccttaaggttttccggcaggataacctctcttcctccatacagtatattgttgcacagatccgcaaacctggcattgtcagcaaagtattcctttgccattgagtcctttgcgctcaatcattctcctcctgttctcttgtgtgagcaggaaaatttggtgccaatgagggtacagtggtacagtttacaaagtacacatgttctgtccttctttaatgtttacgcactgtatacaattcatccgccttttgactacattttctgcattctgtctacatacggcatttcaattttcctgctgttaatgggtaattaaagcattgaaaacttccatgtcttttgtagaatgatgcgaagtggtctgccctcttcaaagtggtgtgcacctgtaaaaaattgttatgtggtgccgcttacagaaatataatgctttgagttgattgtagcatagcggtagttctttgtcatcataatttttcctttttcatacttatattttcattctgccacagcgcaaggggctttatcacatgagaccagctggggcacgctctctctcgtgagcgaatagcgaagctgcttagatactgttgaattatgcacacgatacacagaaatgccctgccacggatggcagggcaaggagaaccgcgccacggacggcgcgtttcgacggtttcgtcgggcatcgtaaatctttaaggcataattcctacagtatcttggctgcgtagcgtagctcacgtgagagagtgtgcacaagccatggctcatgggatgaagccccgtcctactgccagtacctacagttgctatgccagcttcttatttttctcaagaagctcatagattttctcaacatcataatccggcttcattgacaatgccgcttcgtaaattggagcgataacctcctctttttcttccaggtcatctgctatttctgccacactcttgtccttttgcagcttttttacaatcagagaaattatcttttgtctttctcctaattctcggccttcttctcggccttcatttttctgatcttcccatgccttacacatatcaatcacctcttctttctcatctatgtctatatccgttcctgcaaacaggttgattgcctcaaccgtctctctgtctacattgctaaacttttcatcattctgcagcacttcctgcatcttttccttatcatacgcattctgcagtacctcgaaaagctgcctgatggatgtcctgaatcctgtaaagtctgttatctccctcggtgccagcagattaattctgtaatccggtatgaatggcagaagttcttcatccacatcaccaaacatatccgacagcttccttggaccatcccattcctttgttccgagatatactgtaatcgtaatcaccggtatcagcttatcctctttcgtaaattctctctttaaactgattgtagcagagctatgatgttttgtcattatattttttgccacagcgtaaggggcttcatccccctgagaccggctagggcacgctctctctcgtgagcgaatagtggagctgcttagatactgtcgaattatgcacacgatacacagaaatgaactgccactgggatgtaatatatcgttgctgttcaaacgcaagcttgacaccacgctgtcaagctattcgccaataagtcaactattgtcagattacagcccctgcctcgtagaggcaattttaatgggctgtaatcgttactggtcacactgtggtgtgagcagtaatgctcaaggagaaccgcgccacggacggcgcgtttcgacggtttcgtcaagcatagtaaacctataaggcataattcctacagtatcttcgcagcgtagcgtagctcaagcgagagagtgtgcacctgcctgtctcgtgggacgaagccccgccctactgtcagtcccctcagacaaagaggaagcagcctccgcgctttcgctcaaagactgcctcctatcgatcttttttcaactacagctgctatgccagcttcttatttttctcaagaagctcatagattttctcaacatcataatccggcttcattgacaatgccgcttcgtaaattggagcgataacctcctctttttcttccaggtcatctgctatttctgccacgctcttgtccttttgcagcttttttacaacctgtgagattatcttttgtcgttctccgatttccttaccctcttctgttgcaacctcttcccagtaatcactcacattacacatctcgctcatcctcccttcgagttccatgctcattttaagtccataatcttcttcaagtatcttctttttctcgataaactctgactttgagaacagctcttccagcattcctatgagtttattcttagactgctttttattttttgttgctctcgtccggacatttatcagtgcaccatttaatttgtcaatctgtggtattttctttattttaccataaatcaggctggatttcatcccaaattcgattattgaatcctctgattttttcgtatccatacatatccatatagtatatacggattttaaatcatcataatttgaatttacaaactccgttcccttctgctctgatatcattctgcccatgtaataggcaatcctgttttccagccggtagcccagctttgattttttgctgctcttctgggcttcaatattgatgataaattctcttctttttccattataatacaagggaaatttgatgtcgtaaataatttttccatcatcctcatcaactgactcattatttacgttctggattttaactccaagcctttccggaaatcttagcattactgtcggctcaccaatgcacggaattattttctcggcttccatttccttaaattccggcacgagcgcctgaactatataggctgctatctgcggatctgccagaatacacttcacgtagtcgtcactggttgccttgtcctgctctatagagctaagagttctggacaaatttgtcttcacttttctgtatatcatacacttctcctgtttccacatgaaatctgcatacatatcattttttatagccccattttttgtgcatacataatttcaaatgataataaccctttatattcctcaaataaatgcccgccacgcatagaaacgaatagactggtactttagctgatatttatttttaacacacaatcggatttgttgctgacacagcatgataaatcaatgggtaaagaacatccccgaaccatgtattcgaattgtagcctattgtataacagttgtcaatgtattttttcgccacagcgtaaggggcttcatcacatgagaccggcgggggcacgctctctcgcatgagcgcatagcgaagctgcctagatactgttgaattatgcacacgatacacagaaatgagttcccacggatgggagctcaaggagaaccgcgccacggacggcgcgtttcgacggtttcgtcaagcatagataccctataaagcataattcctacagtatcttggcagtgcagcgtaactcaagcgagagagtgtgcacaagcctgggctcaggggattaagccccgtcctactgccaatgtctctgcaccaaaaaagcagcctttgagcttcacactcaaagtctgcttcttttttattttataagctgtccatagcctgatacatggaaagcataggagccataacggctgccacaagtacaccaacaataagtgccagaacaaggataatcattggctcgatagctgccataactgtctgggtagccaactcaacttcctcatcatagtagtctgccagtcgggtaagcatgccttccaagtcaccggtctcctcaccaattcgcgtcatgtgtgaaaccataggtggaaacaatccacacgcagtgattggctcagacagtggaacacccttacttacttcttcccttgcatttttcagggcttttttgtaaagcgcattcttcatggtgtcagcagtgatgccaagggcttcaatcatcggaagtccggagtacacaagtgttgaaagtgtacgcgcatagttactggccgctgtcttgatgtttagctttccgaaaaccggaagctttcttgcgagattaccaaagaacatctggccgctgtcagtctgcttataaagcttgatggctataacaattgctgctatgacagcaatcacaatataccagtatccggtgacaaaatcactcatcgcaacaactgcctttgtgatgcccggaagctctgttcccaggtcattgaacatctctgagtagcttgggatgacctttacaagcattacaataacaaccgcaatagctacaatcacaacgataatcggataaactgccgctttttttatcatgccgttaagctttgctgatttttcgaagtgtgcagacattctgtcaaaagctacatcaatcttgccggatgcttctcctgccgcaaccatgctcaccatgatgtcagggaaaacattcgggtatttttttagaccatccgagagagtctcacctttttgaatctcggcatgaacacctctgatagctttcgccataaccttattctcagtctgatcggataacatatccagcgtatcaagaatcgtaacaccggcattgaccatactggtgaactggcggcagaataccgatagatctctcggctttacctttcctcctacactgaatgagatttccttggtcagtgctgttgccttggtgaggcttatgaccatgttgccatccatcttaagcttattttttgcctctgcttctgactcggctactatatttccttttctttcttttccgctctggtctataatctgatatgtccagtcagccactttcttctcctccttatacctattctgtgcaacctccagataaattaaatcataatttattaagactccacaacattataccataacagtaaaatacatacgattatgccatcaatagtaaaggtgtacacggctagccatgcttaccggatcatgtgcatatgcaactgcagtctccggcgctataaggccctggctgtaatactgtaaaatacagtcatccatcatcatcataccctctctctttgaggtctgtatgatagatggaatctgaaatgcttttgcctcacgaattaagtttctgatggcattgtttgcaagtagcacctcaaatgctgcaattcgtccgccatttaccattggaagcagatgctgtgcaacaattccctctaaaactcctgagagctgcactcgtatctgttgctgctggtgtggtggaaaaacgtcaatcatacggtcaattgcgtcggatgaactgttggtatgcagtgtagaaaatacaagatgtcctgtctccgccgctgtaatagctgtagatatagtttcaagatctcgcatctctcctacaagtattacatccggatcctgtcgcagtgcagctcttagggctgcagcatatgagagtgtatcctttccaacctctcgctgtgccactatagagcggcgccttgagtgcaggtactcgataggatcttcaagcgtgattatatttttggaatctcttgatgcaatgacatctataagacttgccaatgtggtcgacttaccacttcctgtagctcctgtcacgaggacaagtcctctcatctttgtggtgagattgacaaccgactgtggtatgccaagctgctgcggtgtaggcacatcatatgagagaatacgaagtgctgctgcatatgaacctctctgtctgaacacattggctctgactcgtgaaaagccctccaccgaaaaagcaaaatcaagctctccatttttctttagcacatctttaagctcctgcgggacaattggagaaagcaggttgtccgtctcaacattggaaagaacctgatttccctgcggtacaagcattccgtcaattctaagcataaccggatttcccggtgcgatatgtatatccgatgagttctgttgctgcgctgcttttaaaatgtctactatctgcattttcttttcccccttagttttcaaacgtggtctttaacatttcctggaatgaagtaactccttcgagtacaagcttctctgcactctgtctaagtgtatgcatgccctcatcacatgcagccttgtttatatcctctatatcaacaccttttgaaataagtgactttagctttggtgttatggtcattatctcatatataccgattcgtcccttgtagcctgtattggcacatttttcacagccacatggctcataaatctttaccggacggaacgccggtatattcataaaggccttttcctcctctgtcagcagatgctctctcttacatgccggacaaagtcttcttacaagtcgctgtgcaatgattccctttaccgaatccgcaagcagataactttcaactcccatgtcctccagtcgtgaaatagtacttgccgagctgttggtatgcagtgtgctgaccacaagatgtcctgtgattgacgcctgtactgcaatctgtgctgtctcctgatctcgaatctcaccaatcataatgatgtccggatcctgtcgcagaatggaacgaagtgctgatgcaaatgtcaggtcagctttattatttacctgtacctggtttattccgtctatattggcctcgaccggatcctcaactgtgatgatatttacatcctccttgttgagctctgaaagtgccgtgtaaagcgtggttgacttaccacttcctgtaggtcctgtaacaaggatgataccgtttgtattcatcagtatatgatcaaaggccttaagctcttcgtctgaaaatcccagctcctttttatctcttgtaagtgcctttttctgcgcaagtcgcataacgcatttctcaccgaatactgtcggaaggattgatactcggatatcatactctatcttgtctatctccatagtgatacggccgtcctgcggcttacgtttctcggaaatatccataccacctataattttaagtcgtgtaataattgcagaaagcagatgtatactatatgctgccttctcataaagcgcaccatctattctgtatcgcaccctgactttattttccagtgcctctatatgtatatctgaggccctgagtctggctgcctgctcaatgatagagttgacaagtaaaactaccggcgaattgttgacatccttgctggtagcttcctcagcctcggcatttttctgctcacgctcttttctctccctcgcatactcctgagccgctttcatagcctctgtatcaccgtaatatttgtcaagcgtcaaaagtatgtctctgcctgtcgctactgcaggctcagcctgtagattggtaacaattgaaaaatcatcaagcgcaaccatatccataggatcagccatggccacatgcactacattggcattattcttgtcaaatgcatatggtatcataacatgctttctaagcactgtctcactgacaaggttttgcacctcctcaggtatgttgattgcgctcacattaacaagctccagtcccagctgctgtgacaatgcctttgctatctcaagctcattggtgaatccaagctcaatgagtgtttctcctatcttcttatgcttttctttggctataggcagagccttttccagctgctcctgagtaattacattttcatttataagcatatcaccgatacgctttttctctcgtctaaaagccatagtggctccccctctttcatcatttagtaaaatactaccattatgatggctgtatttcaagggtatttatataaaatatacaataaatttatttcaaaactaaaaagtaacgattccgagtgcctgcagcaacagtataagcaggaatgccggtgcaataaatttaaccatgattatataaagcccttttctggtgaatttgctgcctccgcgtgtcacctcatctattattacctttggacttactatccagccaacgaggatacatgtggcaagtgcaacgattggcataagcacattgttgctgacatagtccattatatcaagtatctgtccgactgtgccgtttggaagcttaacctccatatagagcttattgtagccaaggcagactattatctctgcaatcagaccatataccgtgactaaaattgcgctttttctgcggctccaatgaaatctgtctataagactcgatacaatagcctccataattgatacagacgatgtgactgctgcgaatgcaactatcatgaagaatatcagtccaacaatatctcctgctattcccatttcattaaatacctttggcagtgatataaacataagccccggtcctgctgacatgccgtctctgcccataaatacatatactgccggaatgatcataaggcctgcaaggaatgcaacaagagtatcaaaaatctcgatctggttgattgagcccatgagctttgattccttcttgacatacgaaccatatgcaaccatgattcccatagccacactaattgagtagaacagctgaccgagtgcatcaacaaatactgtgacaagcttttgcattgtaagccccttgaagtcaggaaccacatatatcttaagaccctcaagaccacttcttgctgcgcctgatgcatccttataattgagcgtcaatgagaaaataccgattgcaaaaataagcacaacaaggataggcatgagcaccttgctgaagcgctcgatacctttattgactccgccaatgacaactgctgctgttataagcagataaaccactccaaatatgattggtgcccactggcctgtgataaagcctgtgaaatatccatccgcaaccgcatttttaccgcttcctgtaatgaaaagtgtaaagtattttaaaacccatccacctatagtacagtagtaaggcagaataatagccggtactatacatgcaagcacaccgataaacttgccctttggattgataagaccatacgcggtgagcggtccctgtcctgtcttacgtcctattgcaatctcagtggtaagcaatgcaaagccaaaggtcagaacaagtatcagatacaccagcagaaaaagtcctcctccgtcctttgctgccagatacggaaacctccatatatttccaagtcctaccgcactgccggctgccgcaagaacgaacccaatgttgccggaaaaagtgcttcttgatttttctttcattttctactgtctccttaatatattatataatttaatttcgatttaatatggacattgtttccatttacaaatctaatatacctattataatcatctagagtactttttgcaacggttgatattttttattcgcatttgcagtacgtgtggtggcacatggcaggtgtcgtgagtgctacgctatactgtcaagatactgtacgaattatgcctcaaaaactttcttaacttgacgaaaccgtcgctactcgccctccatggctcgatagctccttgtcccggcgtccatgccgggacatttctgattttcatctggcataattcaacagtatctagacagctccgctattcgctctcacgacacctgccatgtgccaccacacgtaacgcaaattcaccacaacataaggaacataagccccaggtaccgcgggcgcacacgtactcccgccggagcgcatagcgaagtggcttagatactgtagaaattatgcccacaaaacgcagaaatacccagccatggacggctgggtaaggcgttatgcgccacggacggcgcataaaagccggtttcgtcaagcatagaaacctatcaagcataatttcgtacagtatcttagccacgcaacgtagcgacggcaggagtacgtggcgccagtggtacccggggcttgcgttccgtactattatcctaaataaggttctttattccctctgttaaacgctttgcaactctcacattgttcatagtgtaaagatggattccctccacatcattagctaaaagctcaattatctgactctcgcagtaagacattccggcatcaaaaagtgcagccttgttgtctccgtatctgtgcacaatcttctggaacttctccgggaactttgctccgcacattgtgaccattctctgaatctgagccgcattgatacaaggcatgatgcctgggataacaggcacattgatacctgcaagcctgcaatcctcagcaaaattgaagaaggtatcattgtcaaagaagagctgcgataaaagaagctctgcaccggcatcaacctttttcttaagattcttaatatcatctaccttatcagctgcctccggatggatgtccgggtagcatgcacctgcgatacagaactgatcgcctgtggtatcctttatgtacttaataaggtcgcttgcatggagaaaatcctcctttgcaggcacgttcggatttctatctcctcttaaagccaggatattctcaatgccctcatatgaaagctgtctggtgaactcatctatctctgccttgttatagcacagacatgtaaggtgcacgaccggctccacattgtactggttcttgattttcttcgcaatctcgatagtcttgttattgtttgagctgccgcctgcgccaaatgtcacgctgatgtactcaggatgacaatcacagagtatctcaagcatctcatctatatttttaaagtcctcctccttctttggtggaaatatctcaaaggagagcgactgtggtttgtttgtatgtatctgtgtaatcttcatgttatcctccggtatatatggttattcaataatttgtaatttttatattccatatattactgtagttttttgtcattgtaaaatatatttttcttttagtttgtcataaataaaatctatatcaaaacttgctgagcatttgatttttttatatgaggtgatataatgggcgaagcaaatcaaaaagaggtttcacaatgaaaaaaatagattttgataatgattcaataaagaaaaatatattgcaggctgctctgcccatgctggcagcccagattctaagcctgttgtacaatatagtagaccgcatatacattgcacgcataccggatatgggaaccactgcactcggtgctgtggggctttgctttcctattataatgctgacaatcgctttctccaatctctttggaagcggtggtgctccgcttttttcaataaaaagaggcatgagtgatgacagagccgccaatactataatgaatacgagctttacaatggtctgcacattcgcagtcgcttttacagctttgtgcatgatttttgcaaagcctcttttaatcgtgtttggcgcatctgaaaatgctctcaaatacgctctgccatacctgctcatttatttgataggaacactcccatccatgatttcaaccggcatgaatccctttatcaacgctcagggctactccactaccggcatgctgtctgtggcaatcggagccgttgccaatctggttttagacccgctttttatatttggatttaatttcggtatcaaaggagcagctattgctacggtcatctcacaaatactgtctgctctctatgtgcttcactttcttaggaaaaaggctgagcttaaggtgcgccttatgacactctctgaattcagtgaaaacacgcgctatgcaaaggacatcataagccttggaacctcaggctgtgtcatgcagctcacaaacagcctggtatctatatgctgcaacaatgtgctttcagtgaccggtggcgatttgtacatatcggtaatgaccatcgtatcaagcatcaggcagatggtcgagactccaatttatgcaattgtggagggttcatctcctgttttaagctacaactatggcgccaaaaggccggcccgggtgagaaaatctattttcactatgggactgctcgtgcttctatatacagctgtcatgtggagtgtgattatacttgcccctcatgccctgattgcaattttcagttccgattccacccttatggatgatgcggtgaaggctttgaatatctactttgcggcattcatatttatggatctgcagtacatcggacagaccacctttaaatcactgaacaaaaagaagcgggctatatttttctccctgcttcgcaaggtgttcatcgttgtaccgctgacatatattctgccttactcctttggtatgggaaccgacggtgtgtttatggcagagcctgtatcaaacgtgattggcggaagcatctgctttgtaaccatgcttggcactgtgctacctgagcttcgcagaatggagcagtaattacagcatctcatcaatgcagatgccgtagcctccggtcggatcatcgacaaacacatgggtgactgctcctattattttaccatcctgtatgatagggcttccggatgtgccctgcactatgccaccggagagctctatcagcctgtcgtctgtcaccttaagctccattcccttgtttgtatctgtcgcttttttatctatatttgttatttccagattatatttttccagttttcccgatatttccgatatcatctgtgcactgcctgtgtgtatctcatccttgccggcgaccggataatacgtatcctctgcggcatattccgacaattcatcgctgtctagctgtccgtaaattcccagattactattgcagtcaagtgtgcctatatggctttttttgccaaaatataccactccgcctatctctcccggcgcgccggcttttccctttttgattttggtaagcttcatgctgtacaaatcaccactgtttgcatacaagagatttccgctttgcgttccgtctcctattccatgccccagcgctccaaaacggccgtcctttgtataataagtgatagtaccgattcctgccagatcgtccttcacccatattcccatatagtatctgccatcatccatcctgacaggcgtgatatccgctgacattttctcaccgcctcgaagaaatttaatgtttacggtacttttatcttcattactttcatcttcatgcctttcatcatattccttcatgatatcattcacagcttcagaaagctcctccttgtctgcaacagtgcgcccattgacagataggatataatccccgcactgcacctttttatctgcaggattgacttttttgccatcctcgtctgtcacctccgtcgtattcactacaagcactccctctgtctgctcatatataccggtcagcctgccacaggcatatacgccctcaacacttattccatcacttattttatctgtctcttcataatctctgtcagtagctctgtgagttgatgctgtatctgctgtctgtcctatgtcttgttcggttccgccgtttccaccgtttccgctgttttcaccgtttccgccgttttcaccattttcaccattctcgcccgaatcagccaatacactggccgcctgtcccggaagccctgtcgcatatcttccatatccggcctttgattcatttaaaaaacttcctaatgcacttccatcaaatgccttatctaccctgctgcaccacttatcatcactgcttagtgcaaacatagctatcactgctgcagccagcgtgacactcacaaattttccaaaaaacttccgcatactattacctccatttggattagtatgctcctgtaatttttcttttattcttttaatatcttattatctcattctaactattccaaattattttgagcaaaaaccagtatagtttgacagtttaggtgttttcctatataatttcgatatatttatatgtttattataaatttcacatattattcccacgttgttagttacaaataaatattgtaatagctttataattcttaaatcaccatttaataaaggagggattccatgaatacatacctgctcatcacatccatagtaatcttcttatgtatcctgctaaatcgtgtctccaaccgcataggcattccggcacttttagcctttatcgtgctcggcatgctttttggctctgacggaataatgaagatagatttcgacaattacgcgttcgctgaacagatatgctctaccgcgctgatatttatcatgttctatggcggctttggcaccaactggcagcgtgcaaaggctgttgccgttaagtctgtgcttttgtccaccatcggtgttattatcacatgctttctcacagggctgttctgtcactttgcccttaatatgagctgggaaataagctttctcctcggtgcgctgatttcatcaactgatgcggcgagcgttttctccatactgcgttcgaaaaagctgaatctgaaatacaataccgcctctcttcttgaagtggaaagcggtagtaatgacccatgtgcctatatgctcacagttgcttttatagccatatcccagggcagcgcaagccctggaaatattgccatactcatagtaaagcagcttgccttcggcataatcttcggcgtcctgattgcaaagctttccatcatgctccttcgatatatacgcttcaaaagcgcggggtttgatgcgattttcatggtgggaatagctataatatcatatgccctgcctgcttactttgacggaaacggcttcttaagcgcctatatagtcggcattatactcggcaacacagaaatagaaaataaaaagaatctggtgaatttctttgatggcataacaggactcatgcagatgcttattttctttctgcttggtctgctttctttcccatcaaagctgccacacgtcatagtaccggcacttttaatatttatgtggctgacctttgtggcaagacctctttctgtcgcacttgtgctcacaccatttcgcagcaaaataaaacagcagctgcttgtctcatggtccggcttaagaggagccgcatccatagtgttttccatcatggcatataccgccaccaatgatgacctcgacaccttccacataatatttatgatagtactcttttcaatactgcttcaaggctcaatgcttccatggatatcacgaaagcttgacatgcttgataaaacagccgatgtaatgaagaccttcaatgattactccgaggaagcagatatccagttcatacagcttaccataccggaaaatcatctgtggtgcggtcacaagctaaaggacctgacgctgcctcctgagacactgattgtgcttatacgaagaggtgagcagaatataataccggacggtgaaacaataattctgcaaaatgatgtgctcgtgcttagtgccatcacacctgatgaggtgcatggtataaaactggtggaaaaaataatagaaaaagacagcagatataacaataaactgctgtctgaaatatcaaaaaaacacaatgagattataataatgatccaaagaaacgggcaggtaatcatcccaaacggaaacgtacggctgaccaccggtgatatactggtaatcaaccgcgccgtaaactgataatgtcagatttttttctccatggcaagtgctttcatctcgcgtgcgctctccatcacggtatctgtgatttttgcaccgccgagcattctggcaagttcagccacgctgtcattgtcagttagtcttcgaatccttgaaaccgtggatttgttctcgaccgctttttcaataaggaaatgtgcatctgccatagctgctatctgtggcagatgtgtgatacatataatctgatggttgcggccaagctcattcatcttctcagagaccatctgagctgtacgtccactgattccagaatcaatctcatcgaaaataagcgactcaatgtggtcattttctgccatgattgtcttgatgccaagcatgatacgcgacagctctcctcccgatgctaccttgccgagcggcttaagcggctctccggggttcgttgatatgagaaactccggcgcatcgatgccgtttgccgtatagtccggcaatctgtcaaactgcatatcaaactgtacatcaaggaaattcaaatcattaagtgctgatttaatttctgacacaagctttacagcactcttttgtctgatttctgatacctcatccgatatctgtgccagctccttttcctttttcgcaagctgctgctctaatttctgtaaataagaatcataatcgttcaggacactgatacgctccctcttttcattgagtgctatcagtatatcatcaattgagttgccgtatttgctctttagatgatttatctcatccagacgcttttgtgtctcatagaaggtctcctcgtcaaactcagcctgtgatatatatcctgatatctcgtgattaaaatcagaaagcagactgtctatctctgacagctgactctccagagcttccacatcctcatcataacctgataccagtgacagctctcttaccgccctgccaataagctctgaggcactctccatctcgcctcctgtggcagaatatgcagcatttacaccctccatgattttctttccgtttgaaaacttcctaaactgcgcctcaagctcctcatcctcaccagacaccagggaagcttcttctatctccttcacctcgtactcaaggaatgacagctcacggcttctttcttcattgtcgatatttgacttttcatactcatccttaagcgccctatatgctttgtatgtgactgaaagctgctgctttttatctccaagcggctgctttgcgtactcatcaagtatatcaaggtgttttttctttgataaaagtgactggtgctcatgctgaccgtggatatctatgagatatgcggctatttccttcattcgcgaaacagacacggcttcaccgtttaccctgccgactgcgcgcgactgtgtgattttacggcttaaaatcacgcatccgtcctcgacctccacatcaagctcccttaaagcctctataatctttgggtcctcaactgaaaaaataagctccacaaaagcaggcttttcattgtctcttagcatctccttttgcactttttcaccaagcgccagattgatagagcctatgatgattgattttccggctccggtctctcccgacagtatatttagtccgtcggaaaactcaacctcacactcatctatgagtgccagattctttacatgtagattttgtaacatattttctccttcctctcccaggcatgacgatatatgttattttctgttacagttcagctataatctgatattcatgtaacattattccacaattctgcggatttttttcatcaccgcatatgtatcatcaacagtccggattgcacacatgattgtgtcatctcctgcaatcgaaccgacgatttctctcatcttcatggcatctattgcagcacagacagcgcttgccattcccgatacagtctttataacgaggatattctgtgccatatccattgacaaaaagccctctctgagtactctttcgtattttttggaaaggttctcaggtgcatccgttatcacagcgtacttctgtctgccgcctgcggtaggaatctttgtgagcttaagctccctgatatccctggatactgtggcctgagtcacgcgaaaaccatctttttcaagaagcgcagacagctcatcctgcgtctctacctcattcttttggattatctcaattatcttggattgtctgtttgttttcatgtcctgccacctcataaatattatttgtaactattcattataacaatccttatctgtgttatgaataatttcccatctttttgcggagtatctccaaaaagcttctctggtgaagcttgcaaatctttgtatgattggctgcctttgaaataacaaaacggtctcccacagccagctctgccgtagtgtcgccatcatagctgacacacgccatctcatcgttttgctccctgcggcttagaatctctatctctatctcatcatcgcctgaaagcacaatgctctttgacgtaagattgtgagcattgttcggtgtaagcagtatcatatcgcccttcggatccacaatcggacctcccgccgacatactgtagcctgtagaacccgttggagtcgcaacaatgatgccatcggcatggtaattgtttaaaaactcaccgtttacatacacattgaggcttaatatctgcaaattgccctttctatggatgactatatcatttaatgcaactctcgaggtctcactgcctcttttatgccctgtgagcataatacggtcctctgtcatgtatttatcagccatgagcgaatcaatagcgtcaaataccgtagcttcctccaactcacacagatagccgagtgtgccgagattcactcccataagcggaatctcaagtgtctccacccttgtggctgcacgaatcagtgtaccatctccgccgagcacaagaatacactgcgtatcctgtggtatatcctcaagctcaaactcgttatcggatatagcctcgacattgctcataagcccctttgccgtgccgcccttttgctctatgtatgccactattttatttgtaagtgcaaaatccctgtccttataggcatttgctatcacaacaaaatgtttcatagtctatttcctgtccagctctccatgcgcggcctcgaccacactatgaatatccactgattcctcctttataggatcatctgtctttttaatatgtacaaggtactctatattgccctctggccccttgattggcgaatactcaaggtctaacacgctaaatccatttgaaagtgcaaaggatatgatattgttcactacctcctcatgcacgctcttgtcacggaccacgccctttttacctaccttttccctgcctgcctcaaactgtggcttgataagacaaaccatctcgccaccgtcctttaacagtgctcttgcaggacctaacaccttggtaagtgatatgaatgacacatcaaccgatgcaaaatccagctcatcatctatgtcattgggcgtcacatatctgatatttgtcttttccatgcacaccacgcgctcatcctgacgcagcttccatgcaaactggccatatccgacatccacggcatacacctttttagcaccattttgaagcatgcagtctgtaaaaccgcctgttgaagcacctatatccatgcacaccttgccatccatcgtgatatcaaagtgcttcatagccttttcaagctttagacctccacggctcacatactgcagtgtctttccatgaatctcaatattgcagtcatcaggaaatgtgcttcccgccttatcctcacggttgttatttacaaaaacattgccctccataatcatggtctttgctttttcccgtgatggtgcaaggcctctgtttacaagtaatacgtctaatctttctttcatactgtatgttacctctatctataatgctgctattatacgcttagccaccgattcggcatccacatgcagctcctttttgagcacctcgacattgccatgctccacatagcagtcaggaagtgcaactgtcaacacctctagagctatgccgttagtcttgacatactccgtcacatgctcaccaaaaccgccgctttgcacgttttcctccatagttacaagcagactgtgttcagccggcagttccttaattgcttccttatcaaaaggcattgcaaaacgtgcattgataagtgtagcagagattccctctgcctcaagcagctttaccacatcaacggcagtctttaccatactgccgagtgccatgatagccaccgtgcttccttttctgattagctcactctttgcaagctctatcggctgtctgatttccttaaggccgtcataggctgcccctcttggatatctgagtgcaatcggaccgtcatatgccactgcaaacttcatcatatcagacagctcccacttattcttcggagccatgattgtcatattcgggatgaccgacagatatgatatgtcaaatattccctgatgtgtctctccgtcactgcctacaagccctgccctgtcgattgcaaagatgacatgcagattctgtatgcacacatcgtgaagtatctggtcaaacgccctttgtaaaaatgacgagtacaccgcaaataccgggataagtcctgcttttgcaagccctgccgcaaatgtcgtggcatgtgcctcggctattcccacatcaaaaaatctatccgggaaattgcggtggaatctgcgaagccctgttccatctgccatggcagccgttatcgcaactacctttggatttctctcgcccagcttcttcatgactgttgagaagacatctgtgtaattggccttcgtgcgcttattctttggaagtcctgtctctatgacaaatggctctgcaccgtgaaatctggaaggataacgctcagccgggtcatagcctgatccctttttcgtaagcacatgcacaagcaccggaccatccacacgctttgcctcatcaaacacacggcacatttcctttatatcactgccatccacaggtcccaaatagataatgcccatctcctcaaagaacatacccggaataaaaagctgctttatgctgctctttgtattcctgatatgctttaccatacgctctccgtagatcggtatatggtttagggaattcatgacattattcttaaaatccctgtatgcatccgctgtgcgaaagcctgaaagatactggctgatgcccccgacgttctctgaaatcgacatattgttgtcgtttagcactataataaaattgcctttaacgcttgaagcgttgttgagcgcctcatatgccatgcctccggtcagcgcgccgtctccgatgactgaaaccacatggtagtcatctccggtcacctgtctggctgtcgcaagcccaagccctgctgatatggatgtggagctatgtcctgtattaaagcagtcacagtcgctctcatccgcctttgggaaaccactcatgcctccatactgtctgagcgatgaaaatccatcctttctgccggtgagtatcttgtgtgtgtacgactgatgccctacatcccacactatcttatccttcggcagattaaagcacagatgcagcgccatggtaagctccacaactccgaggtttgatgccagatgacctcctgtcaccgatatgctctctataagaaactgcctgatttcatcctttaacagctcaagctcctgaggtgtcagtttttttatatcattttccttttgtatcttttctaaaaccatcctatttctcccgatggatcaaatattcaaatagctccttaagaaatgcatcgtcgtatcccaaatcatcaagctgctcctctgcctccttggagatgcgctccacatcagaaaccgctttatccaatccctcaaatgtgacatatgtcgctttattatttttctcgtcactgcctaccggctttccaagcacctcaagtgtacttgtgacatcaagcacatcatcctgtatctgaaacgccaatcccagctttgccgctatctgctccacgcgtgatacctcatcagacgatgcccctgcaaggattgctcctatcatcatcgagctctctataagtgcgcctgtcttaagcctgtagataaagtcaagcttttcccttgtgataggacagtcatcggatttctcgctttccacatcaaccacctgtcctccgaccataccatacacgcctgccttttttgcaagcactgtaaatgctcttgccacacgcgcatcggccacttccatgtcaaaagcctttgctgcggtctcatatgccaggtttaatagtgcatcacctgcaagaatgcccatagcctcaccgtacacagcatgtgtggtcttctttccacgcctgtactcatcattgtccatggcaggcaggtcatcatgcaccagcgagtaggtgtgtatcatctcgattgccgccataaatggctcaatcactgcactgcttccgccaaacatatggtaagtctcttccatgaggatagggcgaagcctctttccaccggctctcacactatagttcatggcctcaaaaataatcctctgctgtccctcctcagcgggaagaaacttctcaagcacattatttatatgctctaccttttgctgcagctcttccatgaattgtgacttatttaaattcccatttaagctcatcagaattcctccagttgtccgtcgctgtttagcacaagcatggccttttccatgccctgtaccatatcattggcactctttacctcatcaagccccttcttgtagagctcaaaggcctcatccagggatacatccgcatcctccatcctggccactatccgctctaagtgtgcaaagcgctcctcgagtgtcagtgttttttcattttctttgctcatcgttaataacctccgaaactacggcccttgcatgaccgtctatcagatatatatttatgtcatcgcctgcattgatatcggatacactgtgcagtgcccccttcttttccacctcgacatacgcatagccctgtgccagctttttggccggtgaatatgcatccagtgtacctgaaagcagtgcaagacgctgtctgcaatccgaaagcctctgcttcataatcctttcaagtgcatcctcgatatctgccaggcgccttttattctcatttagtttattctgtggactaaggaaattaagtcttgttttaatatgcgacagcttttccctgaaaaaatcaatccggcctgtcagatttctgtccatcctgcggcgcagattgtcaaggcgctctaacgtctgtctgtagtcactgactgcaagctctgcagccgctgaaggtgtgggcgctctcctgtctgacacaaaatccgctatcgtccagtcggtctcatgacctactgccgagataattggcgtgcggcagtcaaatatggctctcgccacaatttcctcattaaaggcccataaatcctctatggagcctccgcctctgccgactattatcacatcaagattcatcgcatccaatgtctgtatgcccttcactatgctattagccgcaccctctccctgcacaagtgccggataaagtatgacctgtacatatggattcctgcgcgatgatacattccttatatcctgcacggccgcgcctgtcggtgctgtaaccacaccaatacggccggcatactgcggaatgggctgcttgtactctgacgcaaacatgcccatctcctcaagctcacgctttagctgctcgaatttgagatacagattgccctctccgtcaagctctatctttttggcataaagctgatatgcgccggtcttctcatacacctcaacggaacctgtcacaataatctggtccccctccttcatgtggaaagaaagtcctgccgccctgctgcccgcaaacatgatagcgttcatggctgctcccgcgtcctttattgtgaaataaatatgaccgctcgtgtgatacttgcagttgctcacctctccctttatactcacctgtctgagcataaaatcctgagcgaacatatttttaatatagctatttacttgcgctaccgaatatatatttctatttgccatgttcaatgctctatatcgctgttcctcttaagctatgcaaactttgcaagcactccgtttacaaatgcacctgactcatctgcaccatacttctttgcaagctcaacagcctcatttattgaaacctttgtaggaatatcgtcctcaaactttatctcataaactgccaatctgataattgccagatcaacctttgccatacgattggtcttccagcctgtagacttctcatcgatgagtgcatcaagctctgccatatgctcaataatcgcactgcatttttcatcaatatactgtttttcctcgtctgtaggatttgtaagctcatcatttaaaagctccatctgctctgcaagctcagacttgtcatgaaactcaaccctgaaaagcatcttaaaaacgttttctcttatcttgcttcttgtcatttaaattcctctcgtgaatagtattttatataaattaaggatgtctgtacgacatccttaattatactacatttgtgatcatttaaaaagaactatttaattctctcccatatcaacacttgctatacgaacattgatagtagccacagaaagccctgtcattgtctcaattgcagacttaaccttctcctgtacctttgtagaaacctcagggatgctgtatccataagcaatattgagtgctacatcaaccactacctcattgtctgctatctcaatctgaattccctttgagagattcttcataccgagcctgctgacaatctcgtttgtgatattgcctgccatggagcttactccctcaacctcagtagcagcaagacctgctatgatagctacaacctcatctgctaccttgatctcgccagactcatctgatttgatatttattgtgtttctattctctgccatgtccatgttcctccttaaccggctatacggtctgtccctttgccacgtaaacctggaatgagtcatttcccgtaagtgatctatttcttgatacgcgaacattcttgtctgtgatcacgtactccagattggcgccatcctcaatcaccgtatcctgtagcaggatgcagttcttgacctttgcattctttcctatcttgacgcctcttgataggatgctgttttccacggtaccctcgatgacacagccatcagcaaccatgacattcttggcttttgagccatttatgtatcttgtagggttatcatccctgatctttgtatagatagagttgccactcttaaacaatgcttccctgttatcctcatcaaggagcttcatattctcctcgaaatagctcttcatatctgtaatctgtgaagcatagcctgtgtactcatatgcctggatattgagtgaatcagtgtttgtagccatcagatcccttgtaaaataagaataaccatgtacaaaagcgtcatccactattctaatgagcttctccttctccatgatatagatattcatgccaaagtttaccttgcccatatccctgtcattgatatatatctttttgatacgtccatcatctatatcaaatgtatagtacatctcatcattgttgccgtttggtcttaagaataccttcggtacctcctgcttgcggtacattgcagtgatatcagcccctgtgttcttatgtgcctcaatcagctccctgaaatcaaaattgaatacatagttggcatcagccatgataacatacttctgagtgcactttctcagataacccttaaggctttcgattgcctcaacacggccctcatacaccttaatctgcttctgtgcataaggcggaactatattgataccaccattttttcttgcaagatcaaactcctgacctgagcccagatgatccatcagagagtgatagttcttcttaactatgagagatatattgtcgattccgctatgtaccatgcttgaaatcaggaaatcgcagagtctgtaacgacctgcaaacggaatggaagccataagtctctcggataccatctcagggatgagggcatcgtagctgtttgcaaaaataacggccaaagcctcttcgttgttcatgtttagcattgttcctggccctcctcaacatcattatataccatcgcctttggtcctataaccgctctgtcgccaattgtaactcccggtgcaattgtagcaacatcacctgtcacgtcctccgccggcttttctccaataactgcatcacagcctactgtaaccccctctgcaactatacagtgtgtgaccttagcgcctctttttatcacagtatcacccatgacaactgcatcctctaccacagcgccctcttctacgatgacaccgccaaaaagaattgaatgctttactgtgcccttcactacacagccatcggtaatcatagagtctgtaacctctgcgttgttgccgatgaaatgtcctgtatgaccgctgttacggctgtatatcttccagttctcatcaaacaggttgataccgctgtgctcaggatcaagcacctccatgtttgcctcccagagtgcaggtattgttcctacatccttccagtagccgttaaagtgataagcatacatcctgcggccatccctcaaaaggtttggaatgatattgttaccgaaatcattctctgaatccggatcattttcatcctcgataagatacttcttaagtatatcccaattgaagatataaatacccatggatgcaagattagacttaggattctttggtttctcctgaaactctgtgatcttgtcgtcatcatctgctaccataaggccgaaacgtgatgcatcctcccatggaacctccataactgctacagaaaactcagcatttttctccttatggaacttaaggaaatcgctgtagtcctgcttacaaatctgatctcctgaaagtatgataacatactcaggatcatatctctcgataaatgcaatattctgataaatcgcattggctgttcccttgtaccagtctgagcctgaagccttctgatacggtggcagtacatgcactcctccatataatctatcaagatcccatggctgtccatttcctatgtactcattcaaaacaaacggctggtactgtgtcaatataccaactgtatctatacctgaattaacacaattagaaagtggaaaatcaataattctgtatttgcctccaaacggaactgccggctttgcaagtttctgcgtcagtgcataaagtctggagccctgaccaccggcaagaagcatcgcaactagctcttttgccatattaaaatcccccttgtttaattttattaaatttttgttagcttttgcaattattttggttttttataatggtttatagttatattttaccacactttggcatttatgcaattcaaaattaactaaaaaatactataatttttgtcattattttccaattatctcgcggttgtttatgaactcgtacggcacttcctggtacacataataattaagccagttggaataaagtatattgccgtgtgaccgccactgtaaaagcggtttttgtgtatcatcattatccggatagtagttcaccggcatatctatatcaagcccctttttcttatccctctcgtactcattgtgaagagtatatctgtcatactcaggatgtcccatcacaaaaatctttttaccgtcctgatccatcagaaggaatactccggcatcatccgactccgcaagtatggtaagctcaggattctttaatatatcctcctttaagacctcggtatgccttgagtgtggtgcgtaaaacacgtcatcgaagcctctgacaagtggaatttttctgttctttacacggtgcgcatacacaccaaatttcttctttggaagcacacgctttggtatgccgtagtgataatataatcctgcctgtgcaccccagcacagatgaagtgtggagaaagcatgtgtcttgctccactccattatactgcatatctcatcccagtagtctacctcctcgtattccataagttcaaccggtgcccctgtgattatcatgccatcaaagtatctgtcctttatatcatcaaaggtctcgtaaaatttgttcagatgactgagtgatgtgtgagtggcctcgtgagtagatgtggtcacaaacgttacattgacctgtataggggtatttgacagcgagcgcagtatctgaagctctgtgtcctcctttaatggcatgagatttacaatcgcaatctccagctgtctgatgttctgatgtgatgccctgttttcgtccatcacaaatatattttctctctcaagtatttcctttacaggtaaatcattttgtgtctttataggcattttataacctcttttctaacgcccaaacatctctataaatgtatcctccgagatgataggtattcctaattcttttgcttttttattttttgatgaagtagattcagtgtcgttgtttaccagatagtctgtcttttttgacacgcttcctgtcaccttgccgccttgtgactccacataggccttaaactcgcttctgttggcaaaatcatgcacatcgcctgtaataacaaaggtcttgccgtttaagcttccctccgacatatcctttatatcgaccttttctatgtcaagctccttaatcagtgcttcaaacatcgcgctgttttttggatttgcataccattcaagtatggagcctgacttttcctggcctataccgtctatatccacaaaatctgtggcatttctcattttgtccgcaaagccatcaaaacctattgcgttgacaatcttcttgcctgcatctgtacctataagaggtatacagagtgcaaatatcagattgaccgggtggacatgtctgcttttttcgatggcagcctgcatattcgtgcacgatttttctccaaagccttccatgctgcttattttatcaaaatgctcgggcagatggtatatgtcagggaactgttttataaatccctcatttataaattttagcattgtctgtaccgaaagtccatctatatccattccgcttttgctgacaaatcttgaaaactttttgacattcttggctgtacagtcagggtttgtgcaatgcagcgtcttcacaccgctgtttttactcacaaatatgcgtgtcggatgatgacacaccggacattccttcggtatctcaactgctccaaccgcatcctttacagctatgcatttcggaataatcttgttggcttttatcacggaaagtgtacactcttttcccactccaagcctttctatctcagtcagattgcaaagcgaagctctcgaaaccgtcgtaccctctatctgcaccggctcaaaaacagccaccggcgatattgtcgaaaccgcacacgaccattcaatataacgaagtctcgtatctacagcctcatcctgccacttgaaagcaaaacctgctctcgtagcatgatgccctgtgacgcttccgcctgcagcgtaggcagtgtcatcatagcatatgacaagtccgtccacaggcacatccatcctgccactctcgacatcccttgtccagcgttttacagcctcatcaaggcctgccgcatctgttgcctcccttttgacaacattgaatttcatatcactaagatagctcattctatccccccatgatatgatatcatcatctatatgcacgagtgtaaacgcataaaacactacatgtctgcgcttcacctcttccacatcatcgagatttaatgtaccggatgcaaggttccttggattggcatatttctcatcatcgtcctcgattgtatcatttaacagcttaaaatccgtgtaggaaattgtcgcttcccctcttacaaccatatgtcccttgtatggtatctcctttgggaagccgcttatggcatcctgcaaaaaggtgatgttacttcctacagttccatttcctctcgtcagtattttcacaagcctgccaccgtcatatgtgagcacgagtgtcagtccgtcaagcttccatgaaagccagattggcatatcacctgcccatttcttaagctcctcaatactctttgtcttggcaagtgaaagtgccggatactcatgcggctcacgatttcctgcctctgcctcatagcctgcattatgtgtcggactgtccggacggatatatcctgttttttcctcaagctgtgtaagctcatcaaacattgcatcccactcgtagtttggcattatttcatctgcgccgttgtagtaagcttttgacgcgcggttaagactttcaacaagctcatctatcttatcttttattttgttattctccatgctgtaataatcccctgtctgctttactttgctcttctatcctgatatttcttatccgtatgtttcttatccgtatatttcttatcagaatgatccttattcgtatcaggcataaccggctgattcgaggaatccgcaatcagtcttttgagccccttgtattcaagtggtgtcaccgccctgtactttcctcttggcaggtcaccaagctcaatattcatgattctcactctctcaagcttaaccacacggtagccaaagtattcacacatccgtcttatctgtctgttgtagccctgtgtcagaataatcttaaactgctttgaggacagctttttcacatggcactttctggttgtcacaccaagctctacaagcggtacacctcctgcgagccctcttatgaagctgtcagatattgttttgtttactgtgacaatatactctttttcgtgtctgttgccggagcgcatcatcttatttactatctcgccattgttggtcagaagtaaaagtcccactgaatccttatccagcctgccaattggataaatgcgctttgggtaattaagataatctatcacgttgtttttttcccttttttctgctgtgcagactatgccggccggcttattgagggcaatcagtatcatctcttcttcctttgatactacctgtccattatatgtgacagtctgtccctttagaactctgtcacctgtctttgctgtcacgccgtctattcctactttgccggcttctatctgcctgtctgcctcacgccttgagcacacgcccgcttcactgaggaatttatttattcttacaccattttcttccataccatatcctctttttagattgctttatccgatatacataaaccaaacagcagccttttctactctttacagcagccatttgccatgtagattaaaacacggagacctttaagcctccgtgttgcttcctatgattgtatgcacatctgttactttgtattgcttttactgtcctactgtctggagattctctgtcttgatataagctctgccatttgttccggcgctgtaggatactatagtccagtcgccctctgtgccatatgctgtaagtgttacctgttcctttaagagaccaagctcctttgcatctgtgcttgcaccgtcacgcacctttacaacatcctttgtcactacctgatactcagccggtgcctgtggctgctcagctgtctgctgattggctgcatttgtatccgtggtctgttggtctgtggtctgtcctgcgttagcatccgtggtctgctggtctgtggtctgtccggcatttgcatctgtagtctgctggtctgcagtctggcccgcatttgcatccgtggtctgctggtcaccactttgtgatgcatcatctgcctgctgtgtatctgcctctgtagtctgtgtgtctgcatcagacttctttaaattggcaatgcctgacgatgtgtaccactgctttatagcacctgtgagtgttgtctcaagcatagtctttaaattggcatcagaaccgaccgcctgctcatatgccttttgtacctcctcatgcaggtctgcaaactcagatgaagcagtatacttagaaataagctccataatatcgtcatcgagttcattctcgcagtatgttctgttgaaattactgtatacattgtttataaagagctttccgtccttacctgtctctatataaaagaagtcaagtgtaggtgcctgtgtatcaactcccgtaaactttatgctgtttttaacagacacaaagtatgttccctttttcaagccattcttggtgtaaggtgtgatgtcattgactgactcatagtactggctgacaacaccaatatagctcttctcgttgtcgctcataggtgtcgcaagcttgccaagggtatcaaggtcatcacccacgtatgccttgtaataatcagcaagtaatgtgctgatatcgtccttggcgtcatttgtgtaatccttttcaaactcaaaatccttcaccgaaatctctgtctgtgatccggcttcagtattggattgtctgtcattattgcctcctgcgacaactactataagtataagtatgagtcctacaagtacacctgccactccaacgtattttttattttctgcacaaaactgctttatattatccaatgtttccttgttaaaaaagtccttcatatggttcctccattaacccaacatatcaaaatcaaagtatgtgaccgacgcgaatcgaacgcgcactcgccggagtcggagtccggaattttatccattaaactacggtcacaaaaaaagttaccaactatttatatcacatcttttactttttttcaatgttacttttttcttattatattcttttagtgttttattataactttttatgcatactattataattgataaaaatttgacaatatatttcatttatcttattatttaactgtttgggcattatatattggaaattttttccgatatgccataaaaatataccattttaattaatacaattactatttatataaggagcagtattatgagtttcacatttttaaaccagcttccaactcctgcacagattaaggaggaatatcctctgtcaaaggagcttaccgagcttaaagcgaagcgcgatgcaatgatttcagatgttatctgcggaaaagatgatagatttctcgtcattatcggaccttgttcagccgacaacgaggattcagtctgtgactatgtcagccgtctgacaaagattcaggaggatgtaaaggaccgcgtaatcatcatccctcgtgtatatacaaacaagccaagaacaaccggcgagggctacaagggaattgcctcacagcctgaccctgagaaggctcctgacatggttgagggtcttatcgccatgagaaaaatgcacatccgtgccatcgcagagagtggactcacctgtgcagatgagatgctttaccctgagaactggggctatgttgaggatcttctctcatatgtggcaatcggtgctcgttctgttgaggatcaacagcatcgtctcaccgtcagcggcttcgatgtggccagcggcatgaaaaaccctacaagcggtgatttttccgtcatgctcaattctgtttacgcagcacagcacccacatcattttgtttacagaggctatgaggttgagacatcaggaaatcctctgactcacgttgttttaagaggtgctgtcagcaagcatggcaacactacaacaaactaccattacgaggacttaatccgtctgcacgaaatgtacgacaagatggacgttgtcaaccaggcggctatcatcgatactaaccattccaactccggaaagaagttcaaggagcagattcgtatcgccaaggaagttatgcacaacagacagctttcctctgatatcaaatcacttgtcaagggtcttatgattgagagctatatcgaggagggcagccagaagattggtgagcatgtctacggaaaatccatcaccgatccatgtctaggatgggaggattcaaagaagcttatctacgacattgcagaaatgaattcttaaaccacaaattatacacacatttttttacaaaacacaagccacaggagtatatatcctgtggcttgcattattttgtcggtttattatttaatcatattactataagcaagaactgcactgactgttttggaatcctggattttcccggcataaatcatgtcgcacagctcctttagggtgtatatttctacatcgattgactcggcatcatccagatgctgcttgccctttttcaggtttttggcaagatagacatctacttcttcgtcgcaaaaggcaactgttgtgcgaagtgaaagtaaaaacgagatatcatcagagctgtagcccgtctcctccttaagctccctttctgcacacagtctggtatcttctcccacaaagtctctgcagccggccggaatctctattgtctccctctcgagagcatttctgtattggcgtaccatgattattctgccgtcatcaagcaccggaagcactgccgcagcgccctttctgtgtgagacaaaatcccattcctctgtcttaccgtttgcaaactgcattgtatccttgtatatatcgagtattgaacccttatatacaagctctcttttttgccgtttcatttcatcaatcatttttcctgtttaccttctaaataatttaaattcagagttaccgttttgattagaaatccacctctgtgtcataatagcagcatttgagaagcttctccatctcctcctggcttggctggcgaggatttgagcctgtacaagcatcaaggatagcatttgcagcaatctcaggaagtctctcaaggaatacctcctccggtacaaagccctgctctgttggatagctgtctgctccgtaattcttgatgcagtgtgggatattcagatcatcattcatgccacgtaagtatttgataagaagctcaaccttctcatcaagtgtctctccacccagtttcatgaaatctgctattacgccatagcgttcctttgctgtctcatcctttgcattaaaagcaataacctttggcagatacatggcattggctgctccgtggatgatatgtgcaccataatctgcaaaagctgcgcctgtcttgtgtgccatggaatgaactattccaagtagtgcgttggagaatgccattcctgccagacactgcgcattgtgcatcgcatctctctttgccatatcaccattgtatgaatcaatcaagtcatgctgtatcatctctattgcatggagtgcaagcggatctgtaaagtcactgttggctgttgatacatatgcctcgatagcatgtgtcatggcatccattcctgtgtgtgcaacaagcttctgtggcattgtctctgcaagctcagggtctacgattgcaacatcaggtgtaatctcaaagtctgcgattggatacttgatacccttctcataatctgtgatgattgagaacgcagtaacctcagttgccgtacctgatgtggatgaaatagcacagaaatgtgccttctttctaagctttggaataccaaataccttgcacatatcctcaaatgtgatatccggatactcgtacttaatccacatagccttagctgcatctataggtgaaccaccaccaattgctacgatccagtctggttcaaactcagccatggcagccgcacctttcatgactgtctcaactgacggatccggctctattccctcaaaaagctttacctccatacctgcttccttcaaataagcctcggctttgtctaaaaagccaaatctcttcattgagcctccgcccacacagataatagccttctttccctcaaagctctttaatgcctcaagcgcaccctttccgtgatataaatctcttggtaatgtaaatctctgcattgtaaaaccctccatatgatattttattatatagtttctcccttgtaatatttataaatattgcagccatcaaatacttaatagttgctaaatattacacttaccattttataacattttactaattttgtcacgtaccattatctatttttgtgaatacaagatatcttatacatatatttttatgcaatatgtataattttcttcaatagtaatgaacagttaccgataatttatttcataccataagcactacattataaaaatcggctgcatttgtgtttttcatatgttttcatacattttagcaaaaagaaaaggcttcatacgaagccttttcaaatgtacatgttattatgtcaaaccgacaatacgctaatgctctactttgcgtaatccactatacgtgactcacgtattacattaacctttatctgacccggatactctaactcagactcaatctgcttagatatgtctctggccatgataaccatgtcggcatcgctgacctgctcaggaactaccataatacgaatctctctacctgcctgaatagcaaaagatttctctacccctttataaccatttgtaatgtcctctaactgctgaagacgatttgaatatgtctccaaagtctctcttcttgcacccggacgtgccgcactgattgtatcagctgcctgcacgagacatgcaataagtgactccggttcaacatcaccgtgatgtgattctactgcattaatcacaagtggtgactctttgtatttcttacataattcggcaccgagctggatatgtgaaccctccatctcgtgatctactgccttacctatatcatgtaataagcctgcacgctttgccattctgacatcctcaccaatttcagcagccagtaagccagtcagctgtgcaacctcgatagaatgctttaacgcattctgaccgtagcttgttctaaacttcatctttccaagaagacgcacaagctctgggtgaataccatgtatgcccacctcaagtgtggcagcctcaccctcttcacgaatcatattatcgacttctttttgagccttctcaaccatctcctctatacgggccggatggattcttccgtcaacaataagcttctcaagagctattcttgcaacctctcttctaattggatcaaagcttgacaagataactgcctcaggtgtgtcatctataatcagatctacacctgtcatagtctcgagagtacggatattacgtccctctcttcctatgatacgtcccttcatctcatcattcggaagcgatactactgaaatagtagtctcagacacatggtctgctgcacatttctgaatagctgtaaccacgtaatccttagccttacggtttgcctcttcctttgctttgttttccatttccttaatcatttttgcagtatcaagttttacatcttcttcaatggtctttaagagatattctttagcttgctcggaggttaatccagagattctttcaagttcctgtaaacgctgctcgttaagctttgatatttcaatcttctgcttcttgagttcctcttccttaactgcaaatccggcttcacgcttctcgatagcttcgagcttcttgtcgacattttcttccttctgaacgatacgacgctcattacgggaaatctcgtttctacgctctttgatttccttatccagatcattcttagcctttatagactcttccttgatctcaagcatagactcgcgcttcttttcctccgcagtctttacagcctcatcaatgattcctcttgccttctcctcagcatttcctatcttggagttagcagatttcttctcgtatgaagcggctgcaaaccatacaatcaatgcagtaataataatagaaactacagcagtaatgatatacggtagcattacaggagcacctcctttattaaattttcattgtatttcacaaattacaacaattaaattctatactttttggtgcaaattgtcaaggtaattgtgacctcattgcagaaagaatctggctgctcttaaagcccctgcgcataagaaactggtatatcctgcgaaactccttttcatcacagttatcaggatcatagtgtttcttttcaagcagctttgctatatgtttctcttcatcagcagtgtattcgctgtctatggcacaatttatatcatctctgcctatgccctttgccataagcttctgctcaagctgcctgcggcttaagctgtcctgatgatacctgacatatgtggaagcaaatctgtaatcatcaagataatgaaagctcttgacataatctatcgctgcatccacacagcaatccggatatccgccctgtgtgagcttttccctaagctttctttcactcctgtccatctgttcaagcagatgcagtgctctctttttggctctctttcctaccacctcagatatcagcttttcgtaatccgcttcactgataaaggctccctccataatagagtaccgcacggcctctgtacgatacagcacacatgtcgtgccattatcaaaggtcgtgcggtatttgcctttaccaatattctcatatccggtaatctctatcatatataaccctactcacttattattcttctgcttcagacttttcagagtcttcctgtactgcagcatcttcatcctcaggctgtgtaaagtaaaaatcccttacctttgcctcaagcatatcaaaaaatgccggattctcatggatataagtctttgcattctcacgaccctgtcctatcttgtctccctcgtatgcgtaccatgcaccggatttgttgacaatgcctgcatttactgcaagatcaagcacatctccttctcttgagataccctgtccaaacatgatatcaaactctgcctccctgaaaggaggagctattttattcttaacaacctttacgcggacatggttgccgactatctcaccgccctgcttgagtgactcagttcttctgacatcaagacgcactgatgaatagaactttaatgcccttccacctgtggtagtctcaggatttccaaacatcacacctaccttctcacgaagctgattgatgaatataacgatacaatttgacttgctgataactgccgtgagcttacggagcgcctggctcataagtctcgcctgaagacccacatgggaatcccccatatctccgtcaatctcggcctttggtacgagtgccgcaactgaatcgacaaccacgatatccacagcgcccgaacgtaccattgtctctgttatctcaagtgcctgctcaccgcagtccggctgtgaaatatagagattgtcaatatcaacacctatatttctggcatatacagggtcaagcgcatgctctgcatctataaagcctgcgatgccgcctcgcttctgtacctctgcaacacagtggagtgcaaccgttgtcttacctgatgactccggtccgtacacctcaataatcctgcccttcggaagacctccgagtcctaatgcaatatcaaggcttaatgagcctgtaggtactgtctctacattcatattggctgaattgtcaccaagcttcatgacagagccctttccgtattgtttctcaatctgcgcgatagcagcgtctaatgcttttaatttatcttcctttgccataataatctcctattctctcgcgaacaaacgttcgttctgttattataataatacacttctattcaattgtcaactaataaattggaataattacagaatcagatagctgcccgtgctgctgtttgtgcctcacgctatactctaaaacagctatagctaaaatactcaaaaatatacaaataaaacataattaaaaagacagttgctttcacaactgtcttcattatacacataatctctcactaacgtcaagtccaaattcaaccttgaaatcctcacctagtttcttccaaactcagtaagcacaagtccgtcatttctatcgagtgtcatgccgatgctccactcattgataaacagaagaagcggattgcccttcatatcgacaaccttcttcatgtcgcttgttccgttaattgtatctacattgacctcatccttgttctcaatccatctgatatgctcatatggcagattctctagtctgatctgcacattgtactcattttcaagtctgaatttaagcacgtcaaactgaagcacaccgaccacgccgactataatttcttccatgccgcccttgtactcctggaacatctggatagcaccctcctgcgcaatctgtgtgacaccctttacaaactgctttctcttcatggaatcaacaagtgataccctcgcaaaatgctcaggtgcaaatgtcgggatgccctcaaactcaaatttatcctttgctgtcgtgagtgtatctcctatagagtatacgcccgggtcaaacacacctatgatgtcgccagcatatgccttgtccactatttttctctcatctgccatcatctgctgcggctgtgaaagctttaggctcttgcctccctgcacatggtatacctccatgccggctgtaaactgtccggagcagattcgcataaatgctattctgtccctgtgatttttattcatgttggcctgaattttgaatacaaatgcagaaaaatcctctgaaaaaggatcaatcattccgatgtcagattgtcttgctgtcggtgcatatgtcatcttaaggaaatgctgtaaaaatgtctcaacaccaaagtttgtaagagcagagccgaaaaatacaggtgaaagctctccctttgtgacaagctccatatcaaaatcggcactggcgccatccaacagctcaatctcatccatgagctgacttttaaattcctctccgatctcatcggaaagagccggatcatctatatgaataatcttctccgagccctcttttgtaccctttaaggtatctgcaaaggtcatgacctccttgctgtttctgtcatacacacccttaaactgctttcctgagcctatcggccagttgataggacatgtcgcgataccaagctctttttcgatgtcatcgagaagctcaaacgtatcgttggcatcacggtccatcttgtttatgaatgtaaaaatcgggatatgtctcatgacacagaccttaaagagctttctggtctgtgcctcaacacccttgctcgcatcaattaccatgacggccgaatcggctgccatgagtgtacggtatgtgtcctctgagaaatcctggtgtcccggtgtatcaaggatattgatgcaatatccgtcataattaaactgtaatacagatgaagtaaccgaaatacctctctgcttttctatctccatccagtccgaaacagcatgctttgccgtagcctttccctttaccgaaccggcctggtttattgcccctccgtacaaaagaaacttctctgtcagagtagtctttcctgcatccggatgggaaattattgcaaatgttcttcttttttctatttcctgtcttaagttatccactgatatttcctccaaacaaaatcagagtatagtatagcttaaaacggttcccatttcaagacactaaaaatttatgtatcagtccatcgtcgatatgacaatatttgatgccccgatatttgtcttgcgcttgataatgtcctctatctgagctctcttttcatcagtcacatcttcctttcccacaatcacatcacagcattcatcactgagacttaccacagcattcttaaagccctttgcctccagcatcatctgggcatcctcctccatctgtgcattttctgtcagcttcaccatggcatcgaccgcgctcttcttctctgcctctgacactcctgcatcatcgataatcttctgcagagcctccttgttctttgagcgcacctgctcgcgtcccagcttcacctgtgccacacactcctcgctctctgtggctgcacttgtcagtaccgtttcgccggcatttaatatttcctctgtcgagtctgtctcaagcgcaacctcatctgatgcctgtgtatcctcacattccttagactcctttgtatctgcctttccatttacagcttcgatttcagtggaaagcacatcctttgcattcataaaggtatccctgttatcgtagcttatgtaaccgaccactgccaaaagaagtgcaagtgtcgtaataattatctgattcttatggctgcctttcttcacttttattcctccctggatatcatttttgctatttttattttatgcatgggcacatcaaataatgcagaaaccgcattagaaatatcgttgtttacctgtgggcttcctccgccctgcgctaccacaagcactcctgaaacagtcggtttgtccgtgcttgtgacataaggtacgcttgcatcctcgtcatcgtatatgaccgtagtcttttcaatgctctccgaggtctccttagtatccttatccactatccttgtgccatcgtctgacagcgtaatcatcacagatacctcacccacaccgtccatcctttcaagaataccctcaagctttttttcaagcagtttctcatattcttcatcatcgtaggtgctttcacttaccgacttggctttagctttcttttgtgaattactacaggtctttctatcctcttttaccggaagcaccacaataagaagcagtactccaacaagtaaaatcactatgtagtcagttttcttcagcttcgaaagccgtaaacaaatctgtcgtatccgcgtcatattcatacgaaatcccctctattttctttgtaagctcagcaaatctcatgtcatattcataccctgccgcaagaggttttagaataatgaccgccaaaaacaccccaagcataaacctaaagtacctcctgtactgctcctttggcgttaaatatgtcattaccatgaaaaaaaacgccagatacaaataactcttcatgccctatcaacctcccataaagcttgtagatgcacatactattgcaatcactataaaaaacaatatagatgcatctcttatcacgatataatacagatttcctgccctggcaacggcttctatgccctccacaatcctgttgtctgaaaccggctgcagcgcagcggaaagcaatctgtacatcagcgaaaagattagtgtttttacaagcggggtcagcacaatgaaaaaaagcacgataatcgccgccataccaacactgttttttatgagcatcgcacagccgagcataatttcacctgcaccctgcccaagtctccccacacccggtatcgcctgaaaactttttaagataaggctttccgatattttgtcctttgcgggagcaatcatggcctggactatgcctatgcctgccactatctttatggatgccttcattatttttgtaactgctgattcaataaactctgcaagcttttcaagcttcttttcacttgatacgtgattgagcacctcaagcaccagaaacagatgaattcccggtatgagcaccagctttataagccactccactacataaatgagcacaaatgccagcatgtaaaagccagatgccgaaaatccttttccggacgcaagaagtactgtcgcatatgccggcacaagcgctgtaagataagtcaaaagcacatcaatacagccctttgccacatcagacagcacaaaaaaagatgccataagcattgatataaccgatgcatacataaacagaaagcttacattgtatacataatcctgccgccagaaaataagccttgaaaacaccataaaaagtatcgtatagcacagcacatttataataacaggcttcaccgccgctatttcataaaaaaacagctcataaatatactcacagattttttcaccggccttttgatctcctgccagaattgcatccactatatccgaaaacgatagtctgtccggcagataatcctttgaatatttttcaatctctgacatatctattttttcaagcatctgctgctcaattttatctgtgatttcggtgtccgacgcatacacaaaacactgtggcaaaaacactacagccaatatgattattatcaaaatatattttttacaaatcaaaacagctctccaatcagctctatcagacaagacatcaccggaattgacatcacaacaattgctcccttcgcaaaaagctctatctgcgatgcaattgcgctatgaccacagtccttacagattgaggatgaaaactccgcaatatatgcaatcccaagcatctttaccatagtgacaaaaaatgccggttccacaggaagctttgaaataagtcctttaaaaaactcaattgttgtgccgagccgctccaatgcaaaagcaaaaattatagtgccgcaggccactgaaagaagcattgaaagctcaggtctgtcacgctttaaaagcactgcaaaaaatactgccgcaattcctattatcccaatcttcaacatattacaaagaaaacatatcctgcattgccttaaacagctcacttatatatggcacaatccagaacaatacaataacaagcccggccagactaagcaggaaagtcatttcctcccttccactgtgttttaagacctgtccgagcaccgtaatcactattccaagtgctgctatcttaaaaataatcgaaatctccatcatcaagtcctttcatcgcatacaacaatatgtttaatcggattaccacatttttatacaaacatttttatataagcattattgatatcataatccctcccaaaatccccaccggacaaatcaccttcattttttcaacataatctttcctgtaaaaatctatctgtttatgtatgtccaaagcacattccttaagccgctgctccatcgcagctgcatttttttcaaagaacgcacctcccatttcaactatcattttatttattttttcatcagataccctgccccaaagcaccttctcccacacagccttccagccctcctctccgcttttacaactcctgtttgaaagcacttctcccattctcctgcatccctcattaaacacctcgctctttcctcttatgctgttaaaaaactgtggtgccttcattctttctcctgccagataaaatgcccccttttcaagcaaaagcataaaatcatacagcatcgctatatctgccttttttcttttgctgtaatcgtttatcagccccgataccgcaaacagtactatacaaaagcctgtaagcttcatcataaatgctatagcgcctcacccctttttcatcatggtctataaacacaaaccgttctatggcatgtggcagaatttttcttcgcagatcatctgcattggtgccatgtacactgccaagtatccttattccacaactcacaagctggtttagtgcctcaatatcaccttctcctcccagctcatccactgcaatcacatccggtgacatagagcgcaaaagcatcctcatgccaagtgacttcggacagttatccagcacatcactggaattgcctatatcgttttgagccactcccaagtagcacgctgctatctccgaacgctcatcgaccaccgacaccttaagagctttttttccgtcacagccatctgaaagtattcttatacagtctcttaaaaatgttgtttttccttctcccggccgtgatataaccaatgtattgtaaatgctgttttcatcccggatataaggcatcagtggcattgcaacgtcccttatctgatgggcaattctgatatttaaggacgctatctcactgactgctgtaaccttttctccatcgcaccccatctgccctgcaattcccacacgatgacctccctccactgtaaaatagcctgctgcaagctgcggtgctatcgcgtggaatgaatatccgctcagataatttatcatctcctcaatatcgctatgtgagatatacactccggctctacatcctcccgcaaacatatactgcacctgctttccggcgcgcaccctgatttcctccaggccacacggcatgtacgcttctgcctcagccttcatcttttgtggcagataatcaattatatccatatttttcactccttatcgccacttcggtggcaggtagggatggggcttatgcgtgtggctgcagtgtcgcagaagcgtatagcggagctatttagagtctgttaaattatgctttgaagcacagaaatgccgaggcatggacgccgaggcaaggagatatcgagcccggacggcgagtatcgacggtttcgtcaggcatagaagtacttactgcataatttatacagagtcttaatagtgcagcgtagcttctgcgacactgcagccacacgcgtgagccccatcccgacctgccaccgacagttattcaaataaaaaaaggacacagacgattctgataaatcatctatgtcctatttatattacatgtccaattgttttagaacgtgaaaattattattttttacatcctgtcaggagctgagaatccaagcatatcgatacaagcctcaagtatctcctttgtgagcacaagcagcgaaatatatgacttcttaagctcttcattctcctcagaaagaatctttgtgtcatggtagaagccgttgaatgcgttggcaagctcgtagatgtatgcacatatcttgtgtggtgcagactcctcgtatgcactctcaattgtggcattgaactttgccagagagagcatgagattcttctgtcctgcattgactgccggcatgattgcatccttcagtgcgctgatgttgccaccctttgcctcatactttgagaggattgacttgatacgcacgattgtataaaggatatatggacctgtgttaccctcaaaggatgtgaatctgtcgatatcaaagatgtaatccttgctcgcctgattagacaaatcaccatacttgactgctgcaagcgctacagttttggctgtctgctcagcctccgcctcgtcaatattcagattctctttttccttctggttttccttaatcttattgagcatctcatcgtcaatttccttgaggaggtactcaagacgcattactccaccgtctcttgtcttgaaaggcttgccgtccttaccgttcatggttccaaagccgatatgtacaagctctgtagtatcaggtactatgcctgtctttcttgcacagcggaacacctggataaagtgcattgactgacgcgcgtctgccagataaatcacacggtcagggttgttctccttcatacgcataacaagtgttgcaaggtctgtcgtgctgtaaagtgaagctccgtcagactttaggatgatacatggcggaatctcctttgtatctgtatcctccttcacatccacgaccaaagcgccctcactcatatgtgcaaagcccttttccttcatcatttcaaccatcccaggtacatatggctgtgcatccgactcgcccttccacagctcaaaatgaacattcagattctcataatttctcttaagatctgttacagagacattcatgatatgtgaaagcagtgcctgatagcctctcctgcctccctgaagctcttttgtggcaagaagtgctgcttccttgaagctctcatctgattttgacttgccgctggctgtcggatatatatcctcaagctcagatatggtaaacggtgcctccttcgggtactctcctgtatagctctcatcaaaataaacgaggtcaggctttctctcgcgaagctctgtgatgataagtcccatctgaagtccccagtcaccgagatgcacatcaccaatcacattgtgtcccatgaactttgcgatacgcttaacgctctctccgattactgctgaacgaaggtgtcctacatgaagaggctttgcaacgtttggtccgccgtaatccactactatagtgagtggctttttggccttctccaagccgtatctgccctcgtcatccttcatatcgttcatatattttgccagaaaagcggtatccattttgatattaagaaatcccggctttactgattctactgactcaaacatctcatctgactcaaggagcgccgctaccttgtccgagatcataaatggtgcacacttatactcttttgccgctgccattgctccgttacactggaactcacaaaggtccggtctgtttgaaagtgtaacctttccgtacttctcgtcatatcctgcactgacgaatgcctttgtcacttcctctgatatcaaattaatcagttttttcattgtattcctcctgatatatagctgttttgcgtcaaacagcgaatatatttatattagcacacaaatgaattgctttcaatatcaaccgtcatttttgccttctgagtaaatattaaccggcaacgcaaccttgcatttgcacccccaaaggagtatgatttcatatgaaaatttaaaggaggtcttatcaatgaagataaaaactaaacaaataaccgttactgcaattatgcttgcaatctgtcttgtcagccagttctttaagaacttaagcgtatacatcacaggtccaatcattaatgcagctttaatacttaccgtactctatgccggaatggcatgtggcattatcctaagcattatcacacctgtcacatcatttttcatcacaggaagtcctgttatggcggctatccctgcgatgtttccatgtatcatgataggaaatatcattcttgtggtatgtgtgggactgcttcgcaaaaaatgcggtaaagctgccggttttcccgtatcaattgcaataggtgccatactaaaggctcttttcatgggaatagccattgcacttatcattctacctgcatttctgcctgctccaatgcacaagatgctgccggtattacagcttcagttttcagtgacacagcttatcaccgctgttatcggaggtgtatatgcagtcataattgcggctgtgcttaaaaaaacttctttagcacaggcagactaaatattcaattatctgcttatgcttccagatatccgtgcatatttttaagcgcatttttctcaagccttgatacctgtgcctgagagatatttatctcctctgccacctctatctgtgtcttgccctcgaaaaaacgcagcttaataatctgtctcgctctgtcatcaagcagctttaaggcatcatcgagaaccagattttttacccatgcttcctctttgttttttttgtccgatatctgatccatcacataaagtgtatcaccaccgtcagtatatacaggatcaaagagggaaagcggtgtctggattgcatcaagtgcgtatagtatatcgttttcagggataccgcaatcctttgatatttccgctaaggacggatcatgcaccagctttctcgatagcttttcctttgatttaatagcctgataggctgtatccctgagggaacgtggaatgcggtatgcactgttgtcacgcagataccgtctcacctcaccgataatcatcggaacagcataagtggaaaacttaacacctatagtcggatcaaaattatcaattgatttcataagcccgatgcatcctatctgaaataaatcatccatattttcattatggtttgaaaaccttctgattaccgaaagcaccagccttaaatttccacgaatatacttttctcttgcagccttatctcccttttttattttctcaaacagttcttctttttcatcatccttaagtaccggcagttttgatgtggtcactccacatatatcaaccttatatacagacatgggaatcctccggataaatttctttatctaaagcattcccatttacagtaattttattcaattaatccgcgtatataattctacagcactgccgctatttttatatccttttcatccttaagcaccagcacactgttgtcttcaagcaatgtaactgtaggccttgaatacttctccgtcaaaaaaattattttggcctttttgccgtttgtcaaaagcacagtgcttccgatatatgagcttgcaatcttcttcaaaaacatccctatatacttcggatgatactttgatatgccatcatactcaaaatctgctatcacatcaaacggacacatcccatcacggtaacagcgctttgacgtcattgcatcgtagacatcggctatcgtaataatagctgatatatcatcgattttatctgctgtatatccaaacggatatcctgagccgtcaaacttctcatgatgtaaaagtgccgcacgcttcgtactttcaagaatcttgaaattattaagtatctcatagccatataccgtgtgcttctttatcacctcaaactcttcctttgtgagctttcccggcttcaataatatctcatccggtatcttaaacttgcctatgtcgtgcaacagacctgccatggaaatctcatccagcttttctgtatcaagccctgcccatacaccaatgagacgtgcaatgattgatacattcatggaatgtgccatcgtagatacatctgtctgctttaatacctgaagtgcgtcaaatagctcatatgaagtctcaaacctgtcaaaaatctctaccgagtccctgatgagcgtattcttatccgggatgatattcctgtatagtatgtcattcatatattcatgcaggttatcgatggaatcacggtatttttccttaatgatggcatattttttattccattcttctttttcctgtgctgagcttccctcaacataaaccgaagctatattgtagaatccaaactttgctatatcaaatgccgatacagtctgatgtcttttaaggataagctgtccctttggcgaaaacacatctactgccgtagtcattccctcttttagttcattaacctttatttctctcataatacggtttccctcttgtcatttatcttctcacttgcactcattatatcatgaagctttgcttcatgatcaacattcgtcgttcgccgaatgcataaatgcattcttctcacttgcactcattataccacaatttctctacatgggcactgactttatgtacttcttgacattcaaagcattttttgttaacatagcaaggcgaaaataaatgcgtcagttcgaaaccttcctgacgtaaaacaaaactaaaggagaactaaatatgagaaacaaaaaagtattatttgcagtacaggcagctatgattgcagcactctatgttgtgctcacgtatatcaccaatctgcttggtctcgcatcaggcaccattcaggtacgcttttctgaagcgctttgcatccttccggttttcacaccggcagccattcctgggctttttatcggatgtctgatttccaaccttatcacaggtggcatcatctgggatatcatcttcggaagcatcgctacactgctcggcgcactcggcacttacttcctcagaaaaaagaagtttgtatacacgcttccacctgtcatcgccaacattattatcgtgccactcgtgctcagatacggatatggttttacaactatatacaagggtgttgatatctctcttcttttcaatgcagttacagtcggaatcggtgagattatctcaatctgtgtacttggaagcttgttaaaaggaatactttcgaaatacagaaatgtaattttcaagcaggacgaggcgtagttacatacatagcactttcaataagctgcgcgtcataaaataaaaaagctctgtgtcatacacttatatgtatgcacagagctttttactttattaattactttgatatgctgtgattacattctatctatcccacttatcacacagcgcatttatctggtctgcaaacttgctcaagtccttattagccataccctggcacttctggataacagatacaagcctctggcctgctgccacaagacggtcaaatatagtcttctctctgcttgccatgccatatgcagcctttttctccacaagcttgcgggaaccatctgccaccttctgattcgtgataaggtcataggcatcaccactgtacggtgccactgcatcatagccgaaggtctcatgcacgtggtttgcaaaggactctgctgtggactcctctccatggactataaatacatgctccggcttgttttttattgcgccaagccactctgtaagctgatttttgtctgcatgtccactgatacccggcagatttactatgcttgcccttacttctatttcctcaccaaaaagcttcacctttttagcaccgtttaaaagtgcatagccaagtgttcccggaacctgatatcctacaaacaaaactgttgaatcacttctccaaagattatgctttaagtggtgtctgatacgtccggcctcacacatgcccgatgctgagatgataaccttcggcttcttatcgaaattaatcatctttgactcatccgatgatactgccacacgaagtccggggaacttgattggattgatgcctgccgaaataagctccatagcctcctcatcaaagcagtccgatacattctcatgaaatacatttgtcgcctcaacagcaagggggctatcgatgtaaacttcaaaattcggatgctccggcagcagattctcagtctttatacgcctgataaagtaaagcatctcctgtgtcctgcccactgaaaatgccgggattaccagatttccgcctcttgtaaatgtcgcattgatgacctttgaaagctcaaccgcgtagtcaggcggcgtgtcatgcagacgattgccatatgtagattccataaccacataatcagcactgtccacatactgcggatccttgatgagcggcctgttgtgatttccgatatcgcctgaaaagacaatctttttggtcacattctcctcagtcacccacatctcaatagatgatgaaccaagcagatgacctgcatccacaaatctcaccttaagccccgggcatatctcatacacactgttgtaatcacacggtgtaaagtgctgcatgacattctgtgcatcctccacattgtacataggagtcacttccggtcttccggctcgtcttgcctttctgttcttccactccgcctcaaattcctgaatatgtgcagaatcctttagcatgatgttacataaatctgttgtcgcctttgtcgcaaaaatggtgcccctgaaaccatgattgtatatgagtggcaaaagacctgaatggtcaatgtgtgcgtgtgtgacaaacacatagtctatgagcgaaggattgaccggtatctcctgattcacgtacaaatcagctccctgctccattccacagtcaataagtatatgtgtgtccccaaatgtcagatagtgacagcttccagtaacctctctgtcagcaccgataaattccaataccatactaccatctcctattctgttttataataaaaatattatatcacacttatgccattttctgtatttctttcttcaatctttccattatttttttttcgagccttgatatgtatgactgtgaaattcccagaatatctgctacctccttctgcgtcagctccttattctccacacggtttactccaaatcgaagctctattatctgtctttcacgctcgttcaatgacagcatggctttttttagcagtgaaatctcaacctcagtctcaagatccttatatatgacatcctcatccgtccccagtatatctgataaaagcagctcatttccgtcccaatccgtgtttagtggctcatcaaaagatacctcaagcttcactctgttgttgcggcgcagatacataagaatctcattttctatgcatctggatgcgtatgtggcaagctttattttcttctcaggattgaatgtgtttatcccctttatgagaccgattgtgccgattgatataaggtcctccacgcatacccccgtgttttcaaatttttttgccagatacaccacaagccttagattgtgctctataagctgcttttttgcctgttcctttgacattgccacatttttatccaccagtgcaatcagacagcacttctcctcatctgtctcaagcggaggcggcagcacctccgtccctcctatgtaaaacacctcatttgtgtgcggcttatttccccagagtattttccatacccgttttattactaaaaacagcttcattcaaaatcatatcatatgcattgttctcaaataaactatccgatgctcttcccaccagcacattatgtaaaatcagcttaccatttcccttcatgactgtcatctcatcaaattcacacactttaatgctcccaccatcatttccaaggctcttgtacggcacatcaaaaaagacggcatcttctcctacaatatcaaacaatgcactcccgcctatgtgtaccggaatctgctgtggctgtttttttagcagatttcccgtatcatacaaggctgtggcacaagcccttttaccatcctttaaaagtgtgaccctatacagtcttctgctctcattacttcgctcacagaagcactttaacactatgtatgatatgacaaaaccaaagcatatcataactgtcgcatcagagctgaaaaagctgtccagagctgttactatgcctccggtcagcactgttacaaacatacatagtgcaaaaagtcttagaaacgggatttttctgccagcctgtctgcctattgcaagccttgccgcaagcggtacgaccaccagaacagaggtccatttataaaacgcatagctgcctgccagaagaagcagtacacattcacataccgatgcacccaccgcagaagcaatcagacataccaccttcccggtcaacgggatttttagcatatatatgacaaatataagtatgagacagttggtgataaatgtacgaagaagaaaaatatcgagataaaatgcatagataatttttcacctcactttcacagacaagaatagcgtaaaagcaggtttttaagtgccgtaatatgtcgacaataagcaaaaaagacatgcagcccaaaagctgcatgtcctataaactatcgtcttgaattcttaaggaaatccggaatattaatctctacaggcttaaccgtgctctcaggctggcgtggcttctggatacctgtatatgcatgtgcaggtgctgtctgctgtggctgggcagctgtatgaagtccgcttgttgctgttgtgtgaagtcctgctgtggctgtggattgtgttcccatgcctgaaacaggtcttgcagctgtctgattctgatataccatacggttttgcataccgcctgccattcctgcaccatgcgctgcctgcttggcctgcatatctatcttctctgaaacatcctccagtcctgtagcaataacagtgatagaagcctgatcagtcatgctctcatcaaacttggcaccaaagataatattggcattctctcctgccagatcctgtacatagcttgctgcatcgtttgcatccataagggagatatctcctgagatattgataatgacatgtgttgcaccatttatctttgtctcaagaagaggtgaagcaaccgcaagtttaacagcttcgatagccttatcatccccctgtgcactaccgataccgatatgtgccatacccttgtccttcatgacagtctgtacatctgcgaaatcaaggttgataagtgcaggaagattaataagatcagtgattccctgaactgcctgctgcaatacctcatctgccttcttgagtgcatccggcattgttgtgcgacggtctactatctcgagaagcttatcatttggaatgacaataagtgtatcaacgctctccttaagtctctctattcctgaaacagcattaatcattcgctgctttgcctcaaatttgaatggctttgtaacaacaccaactgtaagtatgccctgatcctttgctatctttgcaacaacaggagctgcacctgtaccggttccgcctcccataccacatgtgacgaataccatatcagcgccctttactgctgcctgaagctcctctgcgctctcctcagcggccttctgaccgatctcaggctgcgcacctgcgccgagtccctttgtaagcttctctccaatctgtataagtgtaggagccttacaaagctgtaaagcctgcttatctgtattgataccgataaactctactccaccaatattctcatcaatcattctgttaactgcattgttaccggctcctccgactccaatgacaataatctttgcgctgttatcagcctcgttagttcttatctcaagcaaggtgattcctcctctttctttcccaaaatttaattttctatataaaaatatcgaatattcttaaactcatttattctataatataatttttctccaaaataatcaactataaaatatgattttttttatttagttttacattattctgacttgtcaaacacaatatttgttgtttcttccgtccagctctctaaatgtagtgtaccggactgtccctcaagcgatggcatgatagccttaagcctctctattttacgtgtaagctttgtagtgtcaccaattatcactctcacattaccatacttgactactggtgcattttgcgcaccataatccacagaatccggcacaaggtcctgcctttttaatccctgtgtaagctcaaggatatcttttagcatagtctgctttataggcagcttctcataaagcactaccttgtcacagcttatgccgtctatgcatggcacacccggcaccgtgtctgaggatgtctccaccacaaagccatccttatcaaaatatgcattctcattaattcccggaatatatatgtatccaagcattcctttttcataaactgatatatgaagagtatgcggactatccaggcttatgctcattgtatcaataaacggtattttttttgtatcctttaccttatatttcagatagacatacagtgagttccatgagtacttatcattaagcaccgcatcctctatagtcttttggtcgtaaagctcattgccctcgacaactaccttttttaccgtaaacagcttaagggcaatgagaaacagtatcgcgagcactgctatcgtaattagcagtcccataaaaaaatgctttaatctctttttatgttttctttttttcttaatcattatatttcacgccttaatctacacattttcaagcctgatgcctcttgacacagacaaaacaagccctatttccgccatcaggaatatgattgacgtacctccatagctgataaacggcagaataacgccggtatttggaagtgaattggtaactaccgcaatattcagtatcacctggattgcaatatgactcatcacaccaatcactaaaagcgagccatacaaatcccttgcattgtttgcaatgaccatcatacgccatataagcagtataaaaagtaaaataaggcagatagcgccaaacagtccaagctcttcacaaataattgtaaatatcatatcattttgtgactccggcacattgccaagcttctgtaagctctctccaagtccttttccaaacaatccgcccgagcctatcgcataaagtcccatcatagtctggaatactgcgtctgttcccgcagtctccggatgcagccatgcctcaatacgtgtacttctatagcctgccagcatgacaaacgccaccgcaaacacaactaccgccactgccacaataataaactgcagatactttgggcttgcgacaaacaacatgcagaccgaaatgcctatgatgataactgccgtactcagattgctgattgcaacaactattatgagcggaataagcatagcaagcacctttaccagacttaaaaatttatcaaactgcttggggatcttgtctataatcatagccataaacagtatgaccgcaattttagccacttctgaaggctggaactgtattggtcctatgccaatccatctcgatgaaccatgtgagcttgagcctatttttggcacaaacacaagcacacacagtataagcgatgctatatacgcaaaaaagccaagctttttccaatatctgtagtcgacctttgccagaaataccataggtataagtcccagtacaatatttcgtatctgaagcttaagatagtgcatgctgtcatgatttttgatggccgatgtgtatgcactcgagctatatagcataacaagaccaaagcagagcagaaatataactataaacaacaggttgtagtcgaaataaggtattcctttttcttttttttctttattcttgctacttcttctacgctttcctgccaaaatatttactccttaaatccttttactatttccttaaagatacgtccgcgctcctcatagttaggaaacatgccccagcttgcacatgcaggtgataagagcactgcatcacctgaaactgcatgctcatagcaataatttactgcatcctcaaacgtatccttctttacagtattcatgaatccgtgtctgtgtgcacactcttcgattttatctgcagtctgaccgataagcacaagttcctttactttaccgtcaaaggcctctatccactcatcatactccgattgcttatcatatccaccgccaatgagaagtgtcggtctgttcatggcacgtataccctgaatggctgcatcaggattggtgccctttgaatcgttgtagaatctgactccccgcttttcggtcacgtactctatcctgtgctcaactgccttaaataccttaagcacctcgacaatcttatccatcggtaccccaaagcttatagacatggcacacgctgccatcacattctcaaaattatgctttccaaggagattcagctcatttacatcaattacctcatcgcgtacaccgtcgtgtgcgtatatgatgatatctccgtccagataaaagccctctgaaagctcagacctactgctgaaaaatataaccttagcagggcactttgctgcaaaatctctaagcacctcgtcctcgtagtttaacacgcaataatcatctgctgtctgattttttgtgatatcctcctttgccctgatgtaattttccatagtatggtgtcgattcaggtgatctggtgtgatatttaaaattgcgcttacatgtggcttaaaggtatctattgtctcgagctggaagcttgatatctctgcaaccgttactgtctcacctgtgcttcctgtgaccattgatgtataagggattccgatatttcctaccactctcacatccttaaagtaattcttcattatctcacctgtcagggctgtagtggtcgtctttccgttggttcctgtgatagcgatgatctcacctgccccaaatgtgtatgcaagctctatctcaccccatattttaacgcccctgtcacgtaaggaattgaccataggaatgtctgttggtactcccggacttagcacagccacatcaaactcatcaatctgttcatctgtcaggtcgcctaaaataagcggcacctccttaagctttggtgctttctcataaagtgtttttgaatccagttctttatttccatcaaacaatactgtatcgatgccatttgcgcacaaaagttcagtcgctgcaatgccactctttcctgttccgacaacaagtaccttttttccttgtaagctcatttttattcctccatcttttattgcagccatccgtatggatatgtttaacaaatcaaattctccaaacgactgccttaatcattaaattatagtatacgttatttagctctatttcgcaagagcccgtaaatcagttaaacactcctatctcctgtgcatacggtatgatttccctaaatatttcagctgcaaccggtgcagcgattgttccgccatagtatgcaccgccctttggattatttattttcacaagcaccataagtgccggatcatccaccggataaaacccaaggaacgaggctatatatacattgtcacttctcggaagtgtctgcgatgtagcagtctttcctcctatcgcataaccttcaacctttgcattttttcctgagccctctgctaccacgccctccaaaagctttcgcagtgtatcagaggtctcttcactgcatatacctgacgtctgttcaaaggacagcacctcttttaccgtaccttctgtgtcatgaatctccttacctatatgaggagtaattctgttaccaccatttataagcgatgatactgttgtcataagctcgatgggtgtgagctggaatgactgtccaaatgaaattgttgcaagctccacctggcctatcttatccggctgatgcattatggtggcagcctctcccggcaaatcaatacctgtcttatcaagcagaccaaacctcatgaaatcagcataatacctctcactgcctattctaaggcctaaatcaataaagaccggattgcatgaattctgtattccctgcacaaaggtctcacttccatgtcctgttctcttatggcagtgtatgcgtctgtcctccacagtaatatatcccgggcagtaaaaactgtcatcaaggctcaccacatcctcctccagtgcgattcctgccgtaattatcttaaatacggaaccgggctcatatgtatcacttacacatccgtttctccaggcttcatcatggttttcacatgaaaaaggatcattcaaattatattccgggtagtcggtcatggcatatatttctccatttttagggtttaaggcaattatactcacactgtctgccaggttttgtgcatatgccatcattgcatttttctcacatactctttgtatatttatgtcgagtgtggtgacaagtgtgtctccttttttgggagcttctcttctctccttatagcccttcacctccacacctctgccatcacatacagtgtatatccgcccgggtgtgccacgcagaatttcatcatatgtggtttcaagcccaacaacaccctgaccatctgctcctgcaaagcctataacctttgaaaacaactcattaagcggatagtacctgacacttgactcgtcaacctttatccctgccaagccatatgatagtattttatcgcctgtttttttagagacattgttctttattttttcaatggatgtaaccttatccaccttactgcggatagtcttttcgtcaatcgaaagctcactgcttaaaacagagatgactgcttccttgtcggttatctgattgtgtataacgcttatgttatatgcagtttcatttgtcgctattatcctttcatttctatccactatatctccgcgtattcctgcaatatcacgctctctttcctgaagcgcacttgcctttttactgtaataatcaccttttactatcatgagataaaacagtctgaaacacaaggcgataagaacagctgtcagtatactgcaaaatacgcatatttttcttctgtagcgcgtattgttaagtatcataaacaaaaatgcctcaatatttttacactaatatatgcaaaaaatattgaggctattctctattcgccctgctcaccctcctgggtgaccttttctcctgtcggaggatttgttcctgttatcgtaaggtcagcatttacaccggtctgttcctcatcagggtatatattcatatacggaagtacttcctttaatatctccctggtcaggttctgtgcatagttactgtgaggctgatcctgtacattcggctggtcgattacagtgtaaataacaagctgcggatcctgcgcaggcacacagcctataaatgatacaagatagctgcccctctttctaaggtgcgttgtctcatcatacatctgcgctgttcctgtcttgcctcccattgagtatccgtcaacctttgccaccttaccggttccgtttgcaactacgttctgcaggtagtttttaagtgtcgcacttgtattctctgacactgtcttttttagcagtgtaggctcaattgtctttactgtattgccgttgtcatctgcgattttctttactacgtgcggctgataataattgccgccattcaccagtgaagaaaatgcactgaccatctctatcatggtacagttatagttctgtccgaatacgtttgtcgctaaatcgacaggctttatattgtcgagtgtatacatgagcgttgatgtatttgcctcacccggcagatcaacacctgtcttttgaccaaagccaaatacactctgataatacagaaaattttctgcaccaatcttatatgacatctgcatgagtgcatcattacatgaatccatgagtgccttttcaagtgtctctaggccatgtccgctacggttgacgcatgataccttttcactgccaaacatctcatatccatcacataaaaatgtcatatcagtagtgagcgtgcctgtatccagtccacatgccacagtaaaaggcttctgtacagaccccggctcatatgtatgtgtaacacagaagttctgccacagcttatttagtgcatccatctcctgagtactgtcctttttaaatgccgcaagctgttcctcgctgtaatatgcactcatatcccttggattgttcaaatcaaaattcggataattcgccatggccagtatctcaccatttttaggattttctataactactgcaatattttctgcgccaagtccttctcttgcattatttgcataagtatctgagaacagttttatcttatcctcaacaatcgactggatatttgcgtctatagttgtgtacagtgtatttccgttttgtgcagcaattactgtcttctggaaatcattgtctgcattcagatagccgtactccctgccatttacaccatttaaagtgtcattgtaatagttttcaagcccggttgtacctacatttccggcggaggtaaagccgataactgagcttgccagtgttttaaacggataatttctctgatactctgtctcaaaccacacacccttgatgtttgggttcttcagattgcccttttcgtctgttgcatcctgcagctgtacaaatggctgaattgcatcatatgacagcttttttaacagtacaatatatttgttatccttgctgttatttgcataatcctcaagtgttgccctgtctaaatccggaaagcactgtgtcagtgcatctatcgtcgaagttatatactctttcttgcttgtcataaccgagcaatcaagtacaacattataaacagccacactcgtagcaagcactgtgccgtttgaatctacaatatttcctctctgaaacggtattgttttgctgtcatatgactgtaatgatagtacctttttagtatatgcgtctccgcttgtatattcaataaacatcagcctgccaatgagtccaagcatggctacaactattaacataaacaacgcaaacagctttgttttcattttgcgtccgatttttcttaccggtctttttcttgtcctggctgccaatatgattcctccaatttattcagggatatcactgtactgatccatatagttgttcttatcaactgagtaataaactatctgatcctgtgaagcatatttcataccaagtctgttgatagctgcatccttgattgcatttaaatcgacagatgtagtaatctgcttgtatctggcatcattgtcagccttcatatcatttatctggctctcaagtgctgcaacctccttcatctgctgtgtcacatttgaccttatctggataagtgaaacagatacaaaggctgaagctgccacacatgctgtaaggaaggctacaaatgccctgttcattgagagtgctctctcctgatttcttcttgcagatgttcttctgtttttctttcttcttatttcctcaagctctcttgtcgatttctgtggtcttctgaccggtgctgcctcgtcaagctctcttacggcattcccatttatataataagtagttttattcatttagctgctccttttgctgtcattctacaattcattcttttcaaacacacgaagctttgcactcttcgagcgtgaattctcttcaagttccttttctgacggaagaataggttttcttgtgataaccgttcccttcgatttattaccgcatacacataccggaaaactcggtggacatgtacatggattttcgttttttttgaaattggattttactattctgtcctcaagcgagtggaatgtgattatacatatcctgccgcccggattaagtaaatctatcatgtcatccaggttgtcccttagcacatcaagctcatgattcagttcaattcttatagcctgatatgttctctttgacgggtgcccaccggtagctctgaccttttggggtatcgctgcctttattatctcgttgagctctcctgttgtcgttatctcttgcttttgtcttgctgcaacaatgtgctttgcaatattctttgcaaacttgtcctcaccgtaatccctgatgatacggtacagatcattttcgctgtaggtatttactatatcccttgcagtaagggaattcctgtcatccatacgcatatcaagcggtgcatcctcactcctgtaggtaaagcctctctttggtgtatcaagctggaaggatgacactccaagatccagcataataccatccaccttttcaattccgagtgaatgaagcacattcttcatatcagaataattgcttctgactatcgttaccctgtctccaaactccgcaagtctctctcctgccgcctttatggcatctgcatcctgatctatgcctatcagcctgcccttgtccgaaagtctcttagctatctcatatgagtgcccggcgcctccgagagtaccatccacatatatcccgtcaggacggatgtttaaattttcaattgtctcgtcccttaagactgaataatgcttaaattccatgtggtctctccatttaaaatcaaattcctatgccaagctctgccatatgatctgctatctcatccatatcgtcaaaatcagagttttcaaggtatctgtctttgctccagatttctactctgctgtatactccgacagatactacttccttatctatacctgcgtattctcttaagttcgccggtaagaggattctgccctgcttgtccacctcacaggtggctgctcctgcaaagaagaatctcataaattttcttgcttctcttgatgtgagtggtttgtcgcgaagattttcctcaatgcgatgccattcttcgttggaatagacgaacagacagccatctaagcccttggtaactacaaactcattaccaagctgttcacggaacttcgccgggacaatcatacggcccttggcgtctattgaatgattatattcgcccatgaacatggcatccatcctccttttcctcattttgaagctttccaccacttcactccacttatatggtatttcgctccactttccaccacttgtttacaatattacacctaacagcctacaaaatcaaggctttaagccaaattaccataaaaaagcatcaaaaaagacgctaagtcttttcgtggactttgcgtcttttttataaaatacatatgaaatttactctttagtggtggattgtggtggagtgtccaccattttacccattttcatctgcttatatctgacaatacctatccatatggctgatactgccaccaaagtggcggcaagtgccatagacaccggataattgatatgtgggatgagaagctggtctgtacgcaggctttctatccagaatcttccgataccatagcctaacaaatatagaagaaacacctctccgtcaaaccttctgtgcttaaaataaagcatcaacaaaataaataggcacaggttccaaaaggattcatacaaaaatgtaggatgcaccgagatatactccactccgtctatcacagttgtatgtgacataagcttttcagtcagatccgatgtcctgacagctgataccggaagctgcatggcaaaaagtccgtcataataatcaccaaatgcctccctgttgcagaagtttccccatctgccaatcacctgtcccagtatcagtccaatccccgccgtatcacacaacagtggaaacgacagctttctgacctttgcaaaaacgaatgtggtgataattgctgctatcacgcctccgtaaattgccagtcctccctgcctgatattgaatatgctaagcaggtcgtccttgtacaaatcccacctgaataccacatagtatattcttgcgcctatcaccgagcatatgattgccacaagtgccagatcaaagtatgtatcaggattttgtcctgattttttggccacatagcaggccacgcccagccccgcaagcataccacatgctattattatgccatacatcgcaatatcaaagcttcctattgatatgctctttatcacatgctgcagatatatatgaagatgtgggaaatttatattataatccatatttttcctttcctgactgtaattgctgtctgtcacaccataatatatacagcagcaatcacaaattacgaaaatatatgtacccggagcaccataaacctgatactccgggcaactgtcattatgcgtctcttagtctacgcctgacactcaaagcttgcacactctgtactgcacttgtttggtgtacagtttttcttgatgccaatctgattggccatgcagctattgtgatcattgtacttacactttgccgcatcacagtgcacatctgtctccttgtgaatagctaactctgcagatacctcacagtcacaggccttgtttgaaaagctgccacactgtgtatcgcaggctttctttgccttagttcctttcacatcgatttctctgagcttacagcagttatctgcattatacgcacatttttcaacattacaatcaagtcttgtcatacttttgcctcctttgcttatgcataggctagtatgtcctgattgattttttttatgctttttaattaattatctgtgtttttcctcttccggaagctccactctgatttcctttgtacggatttccttgcaaatctggtcgatgaaatctgaaagtggcttaacaccctcatttccttcaaaacggcttcttaccgatactgtgccgtctgcctcctcgtcagctccgacaacaagcatatatggaagcttatccatacgagcctctctgatcttgtatccgatcttctcagctctgttgtcaactgtcacatcgacatcattgcgcttaagctcatctgctacctttttagcataatcagcatacttctctgagataggaagtactcttacctgctcagggcagagccatgtagggaacttgcctgcgtagtgctcgataagccatgcaagtgtacgctcatagcagccgagtgatgtacggtggatgatgtatggacggattttatcgccgttttgatcaatatagtacagatcaaaattctcagcaatagcacagtcgagctgtattgttaccatggtatcctctttaccgtatacgttcttggcctggatatcaatctttggtccgtagaatgcagcctcgccatcggcctcaacaaaaggaacattttcctcaataaggatgttacgaagaacctcctgtgttgagttccagtactcatcatctcctaaatacttttctgtgttctttggatcccattttgaaagacggtatgtcacatcattctcgagtcccagcaccttaaggacatatctgttaagattgaagcatgccttgagctcctcctcacactggtcaggacggataacattgtgaccctctgagatagtaaactgtctgacacgtgtcagtccgtgcatctctcccgaatcctcgtttctaaacagtgtggatgtctcacccattctgtaaggcagatctctgtatgagtgctgctttgccttgtatacataatactggaacggacatgtcatcgggcgaagtgccataacctcttcctcgccgtccttctcaggatctccgagaacaaacatgccgtcaagataatgatcccagtgtcctgaaatcttgtacaggtctgattttgccatgagtggtgtctttgtacgcacatagccccactccttatcctcgaggtcctcaatccatctctgcagcttcataatcatctttgtgccctttggcatcataagcgggagtccctgtccgattacatctactgttgtgaaaagctccatctcacggccaagcttattgtgatcacgcttcttagcctcctccattctctcaagatgtgcctttaaatcctctttcttattgtaggctgttccgtagatacgatggagtcttgccttgtttgaatcacctctccagtatgccattgatgatgctgtgagcttgaaagcctttactccctttgtgctcataagatgtggtcctgcacataaatctacaaatccaccctggtcatagaatgaaatctcctcaccctcaggaagctcctcgataagctctaccttgtatggctcatccttttccttcatgaatttgattgcttcctctctagggagtgtaaatcttgttatctcatgaccctgtttgatgattttcttcatctctgcctcaagtgcatcgagatcctctcttgagaatggctgtgaatcgaaatcatagtagaaaccatcgtcaattgccggtccgattgtgatttttgcatccgggaacagattcttaactgcctgcgccagcacgtgtgatgctgtatgtctgatgacacgaagtccttcctcatcacttgctgtgattatattaagtgtgcagtccttgtcaagaactgttcttaagtcaacaatttctccgtcaacctctcctgcgcaggctactcttgcaagtccctcgcttatatcttttgcgatttcatatacgctttttgcttcgctgtactcttttgatgagccatccttcaatgttatcttcatggttatctctcctttatttttaatataaaaatccccgacaccgcattgctgcgacatcggggacgataagctttgttaccgtggttccacccacattctttccgcctgaaaacatactgcttgtctgtatccgacagaaactcatttgactataacggtatcaccgggctttattggagccactccaagctggtgttcggtatatcatccaccggggagctttcaccactctttggactttgattctcgtcttccaaggcttccctctctgctgcttttaatatacttactgtgctcttcaacgtattgttattatgctaatgttcctttcaaaaaatgataatatacttatttttctaatctgtaaagtactttatgcattttttccgcaacattttttatatttcttgcccgaaccgcatggacatgggtcatttcggccgattttcttgcctactaccactgttcctgacttcttctgctcgaggtaaagcgcatgctttgtctctgcgtcaaagatttcatcccatgccgggagattgtaaagccagtctgcctttgcatctaccatgttcttatagagcttttctttatcgaaagcaaggcttacctttgtgtcctcatccatctcctcgattgggtttggggtgacaaggctgtcattgattccgtctaagaagcctgtcatctccatgattgataactcatatttctcagcaagctctttgactgttccctctactgcctcatccggatttgcaaggagcttctcatatacacccttctccaagaggaaataatgctgccaaaaacgctgtaactctccctgatctgctttgtcattgtaggcaatcttgtgccactcttctaataaagccatttttactaccacctttatcttttataaactgatatgaggccaaacagcctcaacttcacatatggatgtattataccaaaataacagcttgacgtcaattttgtttttttatattataattattaaataactattcaaaaaccacggagaacaattcatgaaaaagacaaaacgtattctggcactgattggcgccatccttttattacttttatatgttgtggcatttgttgccactgtgctcgatcacacaagtgacatgcgctactggaaggctgccgttgccgcaactatcattatcccggtgcttatctgggcgtattcatttgtatacagacttttaaagggttctgataaagaatctgatgatgtaaccaaaaaaccatgaaacgcaaaatcacacctgaattatcatctaaagactggaaggaattctgcagccgttttcattttgataacgataaactgccgcttatccgggcaatatacaccgcaatgcttccattggtggatgcctttgcatattattccataaaacaggatttgcccggggtatccctggcacactatgcctacggcctcgtgacactcggaaacggtgtagacgagctgtcagagctgtatttaaaccatgagcagcttgaggaagcatacatagcagactgtttaagcctcatgcttttgtcaaacgcatatgagcagtttgcaaaggctgtcgaagaagaaagctctctttatgccattgagctgtcatttttaggcgatgaatatccgcttgagctgctgcctgagatttttgagcacgtaagccctgatggcatacatctcaccggttcaaatatgctcaagccacttaagacagccgccctcataataaagcttgactcacaaaagcggaaaaatatcaaagagctctgcaatacctgcgcgaactgtaaaaatctgtcgtgcccatcaagaaaggcccctggtcctaagctgccacacacctatggtgccatgcagatttttaatatcagacattgaagcccttctttttctcgtatgagcctctcattttctcaaccagaagtgtcagattcctaaacagtgactcagccgcaaagccaaacactatcatgagaagaatacatatatttgacaaatctgtcagtgcaaacagtttctttaagaagaaacccgaaaataccagacctgctatatttccgataataacagcatatttcattccattgagtggctcactgattttaaagagaatcatgaagcccactaccgaaagtacaagcgtcgctatcgttcctatgcttgcatctgatatacaaaatacttctccgcatacgacaagcgctccgacagctattacatccgtaagtccacccggcagtgcctttagcatgacattggtgataaagtgcccctttatcctgtccttattctgctccagtgccaataagaatcccggtactcctatggtaaacatactgatgagcgatacctgtgccggctcaagcggatacgtaaccataagaataactgaaaacagtgaaagtaacagtgagaatatatttttcacaagaaacagactggctgagcgctggatattgtttactaccctgcgtccctcatataccacatccggcatatgtgcaaaatcagagtccaaaaggacaacctgggctgcctgggctgccgcctcacttcccgatgccatagccacactgcagtcggcatccttcatggcaagtatatcgttgactccgtctccggtcatcgcaactgtatgacctttagcctgtaaagcctttacaagctgtttcttctgctttggtgtcactcgtccgaatacagtatatttatttactgcatcggctattttatcctcagtatcaagtgtagccgcatcgacaaagctttctgcactttcaattcctgcctgtatggcaatccttgaaacagtacgcggattgtcacctgaaataacctttatcgcaacaccctgactcttgaaatactcaaaagtctttaccgcattctctctgataggattggcaagtgccacaaatccaagcggagtaacgctgccatttatgccattctccacgttttctccatcataccttgcaaacaaaagtactctgtctcctttgtcagcgtatggtatgatttcttcctcaatgcgcgcaaagtcttcgtgcatgataaactccggcgctccgagcagatatgttccgtcagaaaaggtaacgctgccatacttgaggctcgacgagaaggccagctgtgaaaccgctgtacgatgcagtgcagatgtattatttgtcaaagcatccgccgcatatgcttttagtgcgagcatagtcgcattgttgtcaaccgaagcatttgcataatctaaaataagacttttaagctcatctaatgtcaaagctgtctgtgtgccatctgctccactgtttttacagagaaaaatttccttaagcttcatatcaggctcagtaattgtgcccgttttatccacacaaagcacatccacacgcgcaagcgtctcaatacttttcatatcatgaagcaaaacctttttccttgcaagcttcatagtgcttaaggcaagcgccactgtggtcagcagatataagccctccggtatcattcctataatcgctgcaactgtcgatgtaacgctctttgtgatagactcgccattcacaaaatggctctgccagaacaatataagcccaatcggaataataactatgccaacccatttgacaatcaaattgatggagcgtatcatctctgactgctccttgccgcccattgattttgcctcaaggctcagctttgagatatatgattcattaccgaccttttcaagccgtgcatagcactctcccgatacaacaaagcttcccgacatgagagtgctgccctctgtcttttctacctcatcagcttcacctgttagcagtgattcatttacctgtatatttccggatatcacaaccgcatccgcacaaatctgctttcctgcggtaagtaaaatcacatcgtcctttacaagttcctccgtactaatctgctttacgctgccgtttctgatgacatccgcacgcggagcattcagtaaactcattttttcaagagtcttttttgcgcggatttcctgaacgattccgattaccgtatttccaataattataggcagaaatgtcagatttctgaaagaacctaccattatgagaagtatcgttatgacaagaaatataaggttaaaatatgtgaaaacgtttgaaatcacaatttcctttgttgtcttgtctgtagatatatcagctctgttggtaagtccttcctccactctctgccttacctcttcatcggtaaggcctgtgatatttatgctgtagctgtctttgttcatctgattcatgctattcaccgtttgtccattattattctacacaataataatggtacaacataagcatgatttcaatacctatttcattaaaaaaggatgaactatttcttaatttcttttcaaattgtaacttatcaatccgttgctactcactttcagtctcagtactctcactgtcttccgttgcaatcatatcatctatagaatccggaattgttccagggattgtggtgcttgaaagatatacatcatcatttaccttgatatagtactcaccaagcatagcgtttttctcaccgattgttatggtatatgtcttgtcggcagtgcttagctttacgacattctgtggctcatccagtccaaaatcagatgtatccgcatctgaatcaaatttctttgaagctgtgatgcttgtagcgtttccaagcagtgatgtaaccttgcttgtattgattttaagagaggtgtcattatcgcagacccactggtcatcatcgtctgtactgctttcggaattggtatctgttttctcagactccgttgactcagtctcatcggaggtatcctctgactttatacggctgaagctatactcctgaccgtcaatcagaaatgagagcgatttgacatccgatgagtcaagcgaaagtgcctcaacactgtcgctttcgctctctgaatcatcatcacttttatatttattgtaatttagaagccccaggtagcccgccaggcaggctgccagaactatcgcaagtatcacaaaagtgcgtttttgcttattcattcattatttctcctatttcctatacgcttttttgcctgtaatctacttttttctcctcattacccatacaacgattcctatgattataagcagtatcggtacagcaatcattatgataagtcccgtaacaaccgcctgcagcgtatttatagtgatattgcttaaggtgtaatccttcaccggtatcacacttgatgcaagctcaacatttccggtcattgatgtgataacatccttgaacatgtctgcattgttgccggaaacggcattgtcatatgaatcatcaaccacataaggcgtaccaaacacaacaatcgatgcgccggtgcttgaatcatttacagcaagacctgtagtaaacggtccgttctcatctgcgtcctctgccttcgatgtggtgatattcttccagtccttctttaaaactgcgctgtctgatgtagaaagcagctttgtatatgtcacatcatctgtatcctcaggataactgattgcacagcttcctgccaaaaatacatatccgtctgttgcatctgaggtgtaatctgtcgtctcaaccgttggaagcaggtagagaggattctgataatattttgagctgtcattttcagctaccacaccggtcttgaagctgacattgtaagccgcaagtatcttgttaaagtttgtaagctcatcattatatgcgtagcagccgataatcattgcctttccaccgccatttaaataatcaatcaccttctgagcgtcttcctcgttgaaatcaacagtcggagaattaatgataatggctgttgcatcctccggcaccttttcctcgttaaagagctctaaactcttaagatttgcatttgccttgcttacaacactctggaaattgcttcctatttccgtttcattgtgtcctgttatctgataaattaccgggagctcatctgcatccattgtgacatactctatagcacttgtaatctgtccctcggcatcatagcctgtgatgctagactgcgactggtatccgtaataatatgatgagctgtcatattcatatatatcattgtaatcaatcacctttgaacggtttttgctctcgatgataaggctgtttgtggtaggtgtcgtgtctgtgtaatcctgataaaacttcgggcttgtcgccgggtctacatattttacctttatatgactcgaaagatccttgtatctgttgattgtctcatctatctttgcatcctttgatttcttggaattcaaaacatagattgtgatatcctcatcgagcttacttaccctgtcctttgtatcgcctgtgagcgagtacagctttgtagccgaacagtcaattgatgtgtacttggcaggaagcgctgtcagtacaagatttacaaccacacagattgcacacattacgacaatcattcctgctgaaaacgcccctgtgcctatcatcttctttgaaaatgcccatcttctcttctggatagactgcgtcgtaagaaagcataaaagcaaaataaccgtcacataataagctgccgatgtgacactaaagcagccactcacaaaattctcaaatggtgtgtacaaatcaaagcaattaagcacctttgtgagcagattcccacttgacgagatgagtcctgtgatggactgcatcatatatgagaggaataatgccgcaaatgtaagtattgcagatattatcacactctcagatatggacgatataaaaagtcccacggcgatgcatgataaaccgtaaagccagtagccaaacaaagccacatacgcttcacttaatgccaccttaccgtaaattgacagcacgagcggtgaaagtgcaaaaagtgctatgtctatggtgtatactgctgccatcgcaaaatattttcctgcgacaatccttccgacagatacaggcgatgtcagcattagctgatctgtctttgtctttttctcatcagaaagcgatctcatcgtgaggattggcactgcaatcatcataataaaaccgattccctttaaatcatatgagatatacggataaccgtttttcagattgtatacataaaaatatagaccatacactgcaagaagtgctgcaacaaacagccatcctataacgttttggaaatatgatttgaattctcttttaaatattgcaagcattatttctcatctccttcccctgtaagctcaaggaatacgtcctcgagtgacttcacaacagtatgcatctcaaggattggcatatgcattgcacttgcaagctcaaatatttcctcacgtatatcgcagtttgcttttgctataaccttagccttcactgttttctcttcctcagacttttcaaatgtgaccttatcaacatttactatcttctcaagcattcctcttgcaccaatctcgtctgatttgaggacaaggttaatttcctggttctttgacatgagattaatcaggttctctgtggcatcacttgctacaagcttaccctttgatatgataaacacatgatcacacaccgcacttatctcacttaaaatatgcgagctaagtatcaccgtatgattttctccaagctttttaataagctcacgaatctctattatctgctttggatcaagtccaactgtaggctcatccagtatgatgatttccgggtagccaagcagtgcctgggcgaaacccactctttgtctgtagcccttggaaaggttctttatgagacggtttttcacctccgtgatgccggtcatgtccatggcatctgctatcatttcttttctctttttcctgtcgagctttttgagctctgctacaaatttgagatactcatataccgtcatatccacataaagcggtggtatctccggcaggtatccgatacatttttttgcctcctcaggctgtgcaaatatatcatagccgtttatctttactgttccaccatcagcaccaatatatccggtaacaatattcatggtggttgactttccggcgccgtttggtcccaaaagtccgtatatctttcccggctcaacagtcagcgaaagatgatctacggccatatggtcgccatatttctttacgagattactaatttctatcacagtaatgctccttcctaaattattatgacatcagagtataaaaaaagagtgttcaatttgtgaattctgaacactcttttgtacattatttataattttaatactatgatattttagctgtactaattgtctgggtactaattgtctgcgcgcacaatcatagcttctctttcagcacctgttccgatgaacttaacaggtactccaatgtatttctctatgaagctgatgtatttctgtgcattctcaggaagctcctcgaaagtcttacagcttgcgatttcatcgccccagccgccttttagctcctcatatacaggctttgcgttgtttaaaaccttaagatttgtggtaaagtcctctgttacctcaccgtttacatcgtagccggtgcagacttttattgtatcaaacttgccgattgtgtcgagatggtttacagaaagtgctgtaagtccgttaagacgcttagcatattttaatgtgacaaggtctaaccatccacatcttctcgggcggcctgttgtggtgccgtactcatgtccgagctcacggattttgtctcctgttgcatcaagcagctctgtcacatatggtccctcacctacacggcttgagtatgccttgatgacaccgtatacatttccgatatctgaagcagaaagacctgttcctgtaagaataccaccgattgtaggatttgatgatgtaacatatggatatgaaccaaagtcgatatcaaggagtgtagcctgtgctccctcaacaaccacctttttgtcatcctcaagtgccttgtgtaagagggtgattgtatcacatacatatggctcaagctgtgctgcatagtcactgtactctgcaaacatcttgtcgaaatcaagctcctttgtataatcagtctcaggatcatataccttaagaagtgcaagcttgagctctgtctgctccttaaggcgctccttgaaatcaggtgcgtataaatcctccattctgattccgcttctctcatacttatcgcagtatgaaggtccgataccctttcctgtagtaccgattttctttgcctgtctcgccttctcaagcgccacatcaagctttctgtgatatgggaaaatgacatgcgttttttcactgatttttaagtatttatctacatcatatccgtgctccttcaggttgttaatttcctctaaaagaacctgcggatttaaaactactccgtttccgatcactccgattgtatgtcctgataagagacctgacggaataaggtgcattgcatatttaacaccgtttgctttgattgtgtgaccggcattgtctccgcctgtgcatcttactgctacatcagcgtctgctgcaaggtaatcaattaccttaccttttccttcatcaccatagaaacatcctattactacatctacctttgacattttacatgcctcccttgtattttctgacacgacacattgtgccatgttactgcttgattttagtggtatatttattatgctttgtaactattaataattatttattacaatactctatcttcttagagcaggctattgcaagcgctccgggccctatatggcatgagaccgaaagtgaaagcggattcatgactatctcgttatttggaaatgctgcctgaacctcttccttaaatgcctccgctgctgcaatatcatgcgtgtatgccatttcaagatttatctggctgccatccggattattgaagcgcttctcaaaatcagacttcatggcatctatcatgatgctctttgcctgctttacggtacgtgcctttgcaaatgcatcaagcttctcaccctgaatctgaagcaccggtttaagctttaaaagtgtgccaagagctgccgctgcaggcgtgattctaccaccctttttgaggtagttaagagtatctaccatgatatatatggaagactcaaactttgcatcctctaatatctgctttatctcagctgcattttttcctgcttctgccaggttcttcgcatctataaccgactggcgcattgtaactgatattctctgattattgactacctgcactttgccgtcataatcctgcgagagcatatatgctgtctcacatgagcttgaaagacctgatgacattggaatgtatacaatctcatcattttcctttaaaaactcatcccatttatctgttacatcaccaaccaaaggcatagatgtcttgatatcgccgcctgccgtaagcttctcatagaactgctcctgcgtcagatcgatattctcataatacatctgctcatcgatgtaaaaaggcattggaatcacctcaactccaagcttctttgcctcgtcaggtgtgataccgctgtttgaatcggtaactactataaccttactcattaattctcactccgatataaatattcgttgtcgtattttttccaacaccgctcattataccataggtgtaattgtttgaaaagaagtttttgatggacagtggcgttattttacttacatcgtagacacggctggcttacaccagcctccgtatattcgtggtacgcacagtaggtgctacttgctcatatccggacattcgtcaaataaaaaatcagaggcaagcgagcttgcctctgattttttattttcctcattgtctacgattacatcatgcccattccggcgccggctccggctggcattgctggagtgtcctctttgattgtagctactgctgactctgttgtgaggagtgttgaagctactgatgttgcattctgtaatgcacttcttgtaacctttacaggatcaaggattccgttatcaaccatatctacatactcttctgtagctgcgttgaagcctgttcccggagctgactcctttaccttgttgatgattactgcaccttcaagtcctgcatttgcagcgatatagtaaagtggagcctcgagtgctttaaggataacctttgcacctgtcttctcatctccctcaagtgtatcaacaaactctgcaaccttctttgatgcatggatatatgctgatccaccacctgcgatgattccctcttcaactgctgctcttgtagcgttaagggcatcctccatacgaagcttagcctctttcatctctgtctctgttgcagcacctacacggataactgctacaccgcctgccatcttggcaagacgctcctgtaatttttctttatcaaactcagatgttgtctcatcaatctgaccacggatctggcttactctgcctgcgatagcatccttgtctccggcaccatcaacgatgactgtgttctccttctgaaccttaactgacttagcacggccaagcatatcgattgttgtatccttgagctcaagtccaagatcagagctgatcacctgaccacctgtaaggattgcaatatcctcaagcattgcttttcttctgtcaccatatccaggagcctttacagctactacattgaatgtaccacgaagcttattaacgataagtgttgtaagagcctcgccctcaacatcctcagcgatgataagaagtcttgcaccggcctgaacaatcttctcaagtaatggaagaatatcctggatgttggaaatcttcttgtcagtaataaggatatacggatcatcaagtactgcttccatcttgtccatatctgtgcacatatatgctgagagatatcctctgtcgaactgcataccttctacaaggtcaagctctgtctgcattgtctttgactcttcaattgtgataacaccatcgtttgtaaccttttccatagcgtctgctacgagattgccaacttcctcatctcctgctgagatagctgcaaccttagctatctgctctttgcccttaaccttctggctcatatccttaagtgcctcaacagccttgtctgtagccttcttcataccacgacgaagcacgattgggtttgctcctgcctcaaggttcttcattccttcctgaaccattgcctgtgtaagaactgtagctgttgttgttccgtctcctgctacatcatttgtctttgtggcaacttccttgacaagctgtgctcccatgttctcgaaagcatcctcaagctcaacctcttttgcgattgtaacaccatcgtttgtgatgagtggtgcaccgtatgatttgtcaagtactacgtttcttccttttggtccaagtgttactctgactgtatttgctaatttatctactccagctccaagtgctgctctggcttctgagccatatttaatttcctttgccatgatttatacgacctttctatttatatatttgatatttaattccaaaatgtaagcagctatgaccggatatgtaaaacgtaccggatctttagcttctatccgtaaattaatcttactctactactgcaagaatatcattctgtctaacgatgatgtactcttctccgtcaagcttaacctctgtgcctgcgtatttagaataaataaccttctgtccgacggttacctgcatcttaacttccttgccgtcaaccattccgccaggtcctactgcgataacctcagcctcctgtggcttctcctgtgctgaacttgtaaggatgattcccgattttgttgtttcctctgcttctaactgctttaatactactctgtctgataatggaactaatttcattgtattgcctccttttatctctgttagcactcatttctttcgagtgctaatttctttctgtaaataaaatatcactattgcatttcaatgtcaacagtgatatttcattttaatatttattttacattttctatatcaatccgtaatgctttaacgcatttttcactccatcatctgaaatatccgatgtgacatattccgcaatttctttaaccggtggcattgagttgcccatcgcgattccatgtcctacactctcaagcatttcaaggtcatttacactgtcgcctatcgcataggtttcatcaagcggaatatccagatgattacacagccatttgatgccggttgcctttgaggttcccttcggcacaaactccacgacattttccacatgctcaagtatcagaaaatcatcagcaaactctgccttcacacgttcataatcagtaccatctatcacgtcagcggagaatttattaattcttatctcgccgtcatatcctcttattatatgtgcatgctcaccaagtgactcaaaaaggtaatccacatacggatcattctcaaagccctcgtcatctatccagtagtctgtggagccctcaagcactacaggcattttacactcagaaagcacccttatgaccttttgtaccatatctgcgctcaggtcattttcgtatattactttgccatccatttcaatatagttgccacatgccgcaattattccatcaaaacccatatttaatagcttctctgacctcacactggctctggcacgtcctgtacatataaatgccagatgtccgtttgccttgagggctgccacagcctctagggtgctttcaggaattaccatgtcatcgtcccatattgttccgtctatgtcaaaaaatactgttttactcatttgctgctcctaatattattattatcatgtcaaacactgctatcttaacatcttataagtcaaatttcaatcagtttatccacagtgccaacacctttagaaagcagtaattttgtatgtcaaaaatcccggtacaatgcaccgggattttgatataaaatgtatgaaataaaatttattaaggagaattgctacaataatttgttactgtactgagagatatgagtatcccatgagactctcatcaacctctctggcagcctcacgtccctctctgatagcccatactacaagggactgtccacggtggttatcacctgccacgtatacgttttttacgtttgtagcgtaatgtccctcctgtgtacttacgtttgttctggcattgagctctacaccaaatgcctttgccacatagctttctgttccaaggaagcctgctgctataagcacaagctctgccggaagctttttctctgatccctctaccggaaccatcatgaatctgcctgtcttctcgtcctttttactctcaagacttacaattgtaagctcctttaggttgccgtttttgtccttgtggaactcttttacggttgtcttgtagatacgtgggtcatgtccgaatactgcaatagcttcctcctggccgtagtctgtctttaagacctttggccactctggccacggattgtttgcggcacgctctgtaggcggacaaggcatcatctcaagctgtgtgaccgatttggcgccctgacggattgcagttccgacacagtcgtttcctgtgtcaccgccaccgataatgaccacatttttgccctttgcagatacaaacttgccatctgtcaggtttgaatttaaaaggctctttgtattctgggtaaggtaatcaacagcaaagtaaataccctttgcatctcttccgtctgcctttatgtctcttggatttttggcaccacagcaaaggattaccctgtcatacttcttgtaaagctctgccggctttatatcctttccgacatcacagcctgtgacaaaatgaatgccctcttccttcattatattaacttttctgtcaataatgctcttatcaagcttcatatttggaataccatacatgagcaggccgccgacgcggtcctctctctcatatactgtaacctcatggcctctctggttaagctggtctgctgccgcaagtcctgaagggcccgaaccaatgattgccaccttcttgccggttctgacctttggtggctttggagccgcatatccgtttgcatatgcagtctctattacaccatgctcattgtccctgactgacaccggactgccccagtgtccacatgtacatgccttctcgcacagtgccgggcagactcttgatgtaaactcagggaaattattggtcttgtgcagacgattatatgcctgctcccagttgccggtatacacaaggtcgttccactccggaaccaggttgtgcagaggacagcctgatgtcatgcctgctattgtcattcccgactggcagaaaggaactccgcagtccatacaacgggcagcctgtttctgctgattttcttttgaaaggaacacatggaactcgttaaagttcttaatacgctcctttggctctacagacgctgcttcgcatctgtcatattccataaatcctgttggttttcccattatctgcgtcctccttagcctcttgtgctggcataaaatgcctcaatctgtgcctgctctgcgttaagacccttttcttccatctgtacaatagccatctgcatacggttgtaatcgtaaggaataaccttcttgaacttaggaagatactcactgaaatgatcaaggatttccttacccttttctgagtttgtaagtgttacatgctcttttatcatttccttaagctctaatacatcgtacttgtttgagacctcctcagtaaataccatctgcttgttggttctcatgtaaaggtcattgtcttcatcaagcacatatgctattccaccgctcatacctgctgcaaagttttttccggtctttccaaggataactacgcggccacctgtcatgtactcacagccatgatcgccgacaccctcaactactgctgttgcaccggaatttcttacgcagaaacgctcaccggcaacaccgtttatgaaggccttaccgcttgtagctccgtaaagtgctacgtttccgatgatgatattatcatccttctcaaacttgactcctgcaggtggatatacgatgagctttccacctgaaagaccctttccgaagtaatcatttgaatctccgacaagctcaagtgtaagtcccttagggataaatgctccaaagctctgtccgcctgcaccgttacacttgataacaaatgtgtcttcatccagtgtatcgtcatatttctttgtaatctcagaaccaaatattgttccgagagatctgtttgtatttgttacctcaatctcaatcgcgcgcttttgtccgctctcaagtgcgctcttaagctgtgtcatgatctcagtcatatcctttgtctttgaaagctcaaagtcatatacctgcttaggatcgaatataacactctgctttttgccgtcaaacggattattaagtatgcagtcaaggtcaatctttgactgtctctcgcttagattatcacgcttctttaagagatctccacgtccaacgagctcatccactgtctttacgccaagctttgccatatactcacgaagctcttcagcgatgaaacgcatgaagttctcaacgtactccggctttcctgcaaagcgcttacgaagctcagggttttgtgtagcaattcctgccggacatgtatccaagttacatactctcatcattacgcagcccattgttacaagcggagctgtcgcaaaaccgaattcctcggctccaagacacgctgctattgccacatcacggccactcatcagcttaccgtctgtctcaattcttactttatttctaagaccattcataagaagagtctggtgtgtctctgcaagtccaagctcccatggaagtcccgcattgtggattgagctgctaggtgcggctcctgttcctccgtcgtagcctgagataagcactacctgtgctccggcctttgcaacgcctgccgcaacagttcctacaccggcctcagaaacgagcttgactgagattcttgcatctctgtttgcattctttaagtcgaatataagctgctccaaatcctcgatagaataaatatcgtggtgtggtggtggagagatgagtgcaacacccggtgttgaaagtcttgtctttgcaatccaaggataaaccttctttccaggtaagtgtccaccctcgcccggcttagcgccctgtgccatcttaatctgaatctcctgtgcgcttgttaagtatctgcttgtgacaccaaaacgtcctgaagcaacctgcttgattgctgaacagcggttctttccgtcttttccgattgtgagacgatccttgtcctctccaccctcgccggtatttgattttccgtgcagatggttcatggcaattgcaagtgtctcatgtgcttccttcgaaatagatccgtatgacatagcacctgtcttgaaacgtgtcacaattgagtcaacgctctcaacctcctcgagcttgacacccttcttaggatagttgaaatccataagtccacggatatttgtatttttctcttcctcatccacaagtgctgtgtactgcttgaacagattgtagtcaccgcgctgtgtcgactgctggagaagatggattgtagccggattgtacagatggtcatcagctccgcttctcatcttgtgtcttcccttgctgtcaagtgtaacatctgtctcaagtccgagcggatcgtaggccgcagagtgaagctcattcacatcgttctcgatatcctgtaatgtaattccaccgatacggcttactgtatttgtgaaatacttatcaataacactcttgtcaataccgattgcctcaaaaatctttgagccctgatatgactggatggttgaaatacccatctttgctgcaatttttacaatacctgtgatgattgcatggttgtaatcatcgattgctgcataataatccttgtcaagcatatgctcgtcaacaagctgcttaactgtatcctgtgccagataagggttgattgcacttgcaccaaagccaagcagtgtagcaaaatgatgaacctctctcggctctcctgactcaagaatgagagaaagagatgttctcttttttgtctttacaagatactgctgcaatgcagcaactgcaagcagtgaaggaattgcaacgtggttctcatcaacacccctgtctgaaaggataataatgttggctccgtccctgtatgcacggtcagcctctatataaagtctgtctacagctttctcaagacttgtgttcttgtaatatataataggtaaaacctctaccttaaagccatcggcctttaaattcttaatcttcataaggtcggtgtttgtaaggattggattgttaatcttaagtacacggcagttttccggcttttcctcaagcacgtttccggcctcaccgatatagagtgtggttgatgtgacaacctcctcacggattgaatcgataggcgggtttgttacctgtgcgaagcgctgcttaaaatagttgaataacggctccctgttaccggataaagctgcaagcggtgtatcagtacccattgctgctgtgccctcaacaccatttttagccatcggaaggattgaatccttgagtgactcatatgtgtaaccgaaggctctctgcattctctggcgctcttcctttgtatactcaggtactctctggttaggaatctttaaatccttaagatttaccatgtatctgtcaatccactcaccataaggctgcttgtctgcatatctctccttgagctcatcatcatctatgatttttcctgcaacagtatccacaaggagcatctttccaggacggagacgatcctttttcacaatctttgtagggtcaatctcaagtactccgacctcagatgaaaggataaggtaatcatcatctgtcacatagtaacgtgatggacgaagtccgtttctgtcaagcactgctccgactaaatcaccatctgagaatacgattgaagccggaccatcccatggctccatcattgtagcgtaatactgatagaaatccttcttcttctgagtcatgattgaattgtttgcccatggctcaggaatcattatcataacggcaagtggaagctccataccactcattaccaggaattcaagcgcattatcaagcattgctgagtcagatcctgccgcattgataaccggcaaaaccttctggaactcttttttaagctttggagactccatgttctcctcacgggctgacatcttgtcagagtttccaagaatagtgttaatctcaccattgtgcacgataaatctgtttggatgagatctctcccagcttgggtttgtatttgtagagaatcttgaatgtactgtagcgattgctgactcataatcaggatcctgtaaatccatgaagaactgtctgagctgctctacaaggaacattcccttatatacgattgttctgcttgagaatgaaaccacatatgtattgtcgtttgactgctcgaaaacacgtcttgcaacatacagctttctgtcaaactcaagtcctttctcaacatcctcaggtctttttacaaagcactgcatgatgcatggcatacagtctctggcttttttagaaagcttatcaggctctgtaggcacttctctccatccgagaaattcaaggccttccttctccacgataacctcaagcatcttctttgcctgaatagtcttgaactcatcattagggaagaaaaacattcccacaccgtaatctctctcatctccaagctctattccaagtggctttgtaaccttcttaaaaaacttatgagaaatctgaagcaggatgccgacaccgtctcccgtcttaccatcagcgtcttttccggctctgtgctttaagttctcaacaatctttaaagcattctcgactgtctcatgtgttttgatacctttgatatttactactgcaccaattccacagttatcatgctcatagcgtggatcatataatcccttagctgtggctgtgctttcattccattgtttactcataggttcttcctttcctagtgtaaatttgttaacggataacttattaagaagtgaatcatttcctgtttatgattttacaactatgaaagctcaatgtaaatagtttttttctcgctattgtctgattatttgataacttaatattataaagttatttttctgactataattgtatttttgtcttatttataaggttatacgcacaatttactgtttcaaatttcaaaacttttttcaataaagcaaggcataaaacactgtttcagcaaattgtgtctgaattgtgtatgtattacaatagcttttcatgtcttatattaaaaaaaatcagctatacttttttgtatagctgatttttataaacatccggtaactatcccaaatcacattgctcatattcgtaaaactgcacgatacttgtactttgtgtgcactccatttcggtcctgctaaacagttccttctgtgtgcttcgcataataataaaatatcacaatgccaacaccaaggcacatgaccgataccacccatgccattacactgccatcaacagtacacttcaaaataccggtctctgtccttataacagcaaacgcatttgcggtaatatgaccaatcatagctgcatacacatgccctgacttatacataaaagccgcaagcacaaggccaagtaaaaaagcatagacaaactgcactatattaaaatgaatgagcccaaacaaaagcgccgacaaaaatacagcctgtggcacattcattattttgcgcatatttccaaatacaatgcctctgaaaacgagctcctccataatcggagaaagaattgccgagccaatcagctcaattacaagagtgcttgcataaaagctctcatttgccctggcatatccttctgagagcccgataagcggtgacatggtgatgatattattgagcgcaaatgaaataaaaagtgtaatcacaatcacccagagcacatttataaaaagtgccctgtctatctttggttttttaacaaacatctgctgagttggcttatagcttgcaaaatacataaatggtattgtgattgctgcagatattatctgcgctatcatgtatgtcgaagctgtatgtccgatgaacgcaaaaataaagtacattgcgctcagaaaaacaatgtagtaaagcacaaccgggacaattatctcccacactatcgctcttaattttaaattcttattcatgaaatcccattcctatctactgtttataacctcaggtctcaatgcattgcattttcataaaagctaatcgaaaagcttagaaatcacatccggaagctgccttatatcatctatcacagcttttgcaccggcactcaccatctcgttaacatctccaaagccaaagcttaccgctatgcttggcacattgacacgatttgctccctcgatatcaaacatagtatctccgattaaacacatctcatcccttggaatgtctgaccaccggcgcatcacctcgttaagtacttcttcctttgtatctatcctgccgtcaaatgtagctccgaccacctcatcaaacatatccagtattccaaaatgctccaaaatacgctcacacgatttttccggcttcgatgatgcaagtcctatcctatatccggctgctttaagcgcctctatgcattcctttactcccggaaaaagcgaacattcaaatatacctattttgttatagcgttctctgtacttttcgaccgcttcaagtgctctctccttagtaaatccgtaatgctccataaatgtgtttatgagcggtggtcctataaagaaaaacaggctgtttctgtcaggctcagatatgccaaagtgtgaaagtgcatattgtgccgactttgtgatgccctctgatgagtcaatcagcgttccgtccaaatcaaataatattgctttcatttgttatctccattgctttaagtttattgtactattaattaaaatgctagttcagtatctcatttaacactcgtccgacagcatcggcaaactcgttgatactctttatcttcacgagacttctgccgaatatctttgttgcaagctcactgtcatgcgcacttcccatgaagatgccaattacgtctattccatggtttttaagcctctgcacctcatttacggtgtccttaacagcaagagcatcagtgtactccctgtccttataaaaggctccctcccctgctatctgatcatcctggggacttgcatccgaaaacatgaaaagtaacttctttggctttggacttagctccatcagatgtgatgccgcgcgcagagcaaggccatccctgttatttcctgccgcaacaaaatgaaataattcatcctccacaccataatcatcatattccttaaaaatatgcatcaccgtgtagcctcttatgctgcaatatgagtaaatctgcaccggtatgccacaattagtcagactctttgacagtacatatgcctgtgctgctatcttctgctgcatctgttttctggaagaagacgcatccatcagtatgtcgacagaaaagcccggtgtctccacctcatcttttcgctcaaaaacacgcggattgtccagatacagggccttccatactctcgcaggctttatacggccgtgtgttgaagcatccataaatgtctcatctgctgtctccaggtgcattctaaggctttctgtaagtctccttatactgttttgatacactgccatgtttttttcaaaatgctctttattcttgtcgtattgcatggctgtctcttttgtaaatgcaagaatttccctgcgctctcttttgttgtcaatctcatcaggtatagtctgctttttctccgatgaaatacctctggtaaaaagcaaatgacagtttttgtgatttcctacacagagctttttctccagctcggcctgttgcctgtcagaatacatgctttttccaaaacaggctgtcacataccgcttcgcttctattggatctttctgcagtgcaaactgcagcagatatctctttgaatgctccatagacaaagctgctgtatccgaggccatatttttatcataaaagctattcgctctgacatactgtgtgctgacttttcctattgagtgaaatgctcctgctaccttctgtaaaaaatatatgccctgcggctttgccacctttatcagcttatacgagaaatacttccacagattttctcgcgttttcactataatctcatccgttgtcatatcaggtgtaaaacaaaaagcatgcagtatctcttcatcctctttgcaaagacctgatggctttccaagtatccttctgcaatgtgcatttctgattatatcaatcctcgaatactccctgtttttattgactcctgcaaggctctttttcgcgtactcaagccttaaatcatataagacaggcctcgtttgtctctccttttcatacagggcattttccaaacctatccataaaaggccctcataaagcatggcgttttttcctgtcagctgattgaataaggcatctatcttgtcatgctcataccacttgtattcaagcccaataatcagattcagataaatatcagcggatccatcaggtgcaaatgccagaaaaagcggctctatgtcatagtcacaggccgccatccatatgaagtttcttgctctttttgcttcctttatatcctgttcttccatatgttccattccttcatatgtcacaagctcatatcaacaaaacagctgctctccgctcatcttccttgagattcttgcacggattgtatcacggataagcgtctgctcatactcatcaaagctcttgtttgttatacccatatccagagctgtatatatatttaagccattttccatcataccaattgaaccgatgagaccacgcagatcaagtgcctttgatgatatttcgccatttttgcacttggtatgcagttcaagaaatacctccgcaagctcatttgctcccgcttcacgtattgcaggataatgttcctttatgagcttcacaaggctctcttttgaaatcataggcatccggattaccgcaaaacgtgatacaagagcctcatttagctcctttgtgcctgcatagccgtaattcatcgtggcaataaatcttgttgccggatgaagcgacagtctgtcatagcccggcacatctattgtacgtctgaaatcaagtgtggcatgaagcactgccatagcctcactttttgccatatttatctcatcaagtaccgcaaagccgcctgtttttgcggctgtatacacaggtcccggcctgaaggttacttctccggcgctaaacgtatcggttccgataagtgatgctgcatccatatttacgtgaaatgacacatcccagcgtggtctgttaaatacacctgccagattctctgcgaaaagattctttcctgtggccttttctcctactaaaagcagattttctccacataaaacggcggttatagcctgctcccacacatcgcttccgtaataaaattgtgtaggcacggggattcttgactcatactccttgtccaccggatactgcgagcgaaacttttcaatttccttaatcagattttctgaaatgccaagctctcttaatttgtccaacaagctcatcgcttcctttcatgtcagatattttaactgttataggccatacatactcaaaaccgtacacagtttatgctttacgttatattgtcatacgatatattatttctttacgcccttggtgtcacggtttgcaatgtgcagcctgtgaagcgccacctgcttaccctttacctcgacctctttttcctccaggtcattaagcagataaatatcagtaagctcatcctctctgtcaagtctcattcccctgacacctactgctgcctttttcttttcaggaatagtgccacagtcgattcgaaggaacatctccttctttgaacgcattaccattgtagcattctctgaaagcatgtcaacaaacaacagctcatcatcatccatgagctttgtagcctgcgaggtctttcgtgtcaccacaaactcagcaccatccacgagctttatcatggctgacttcgttccaaatataagcttgtgcttttcaacatccataagaggcgctataaatactatatcctccttactgctgtcatagttgcttacattgtcaataggtgtgcccttgtcacggaatttgccgtaaggcaggtctaacaccttgacaagatgcatgtttgccttgtttgtgaaaatgcacagcttatctatatttttgacctttaatatcagcttgttctctgcgtcagctgtatctttgtttctatcataggttgaagtatctactgttttcacatagccgaagcggtccataagcagcactacatccaatacctcaagctcttttttgaccacaactgcttcctcgagattatcaagctctgtgcgtctgtcccttgcatactccttgcggaacgctttaagctccttcataatgacctttgccatggatgagcgatgctctaaaatatcgctgtactctgcaatctttgccctggtctcctcgtgctccttaatcagagcctcaatttcgagtccaatcagcttgtacagacgcatttcaaggatagcagctgcctgacgctcagtaaagcaaagctgggctgccatggcttctgaagcctttgacttgaatttaattccctctgtctctccgtttatgagacatgcctttgccattttctggtcacggcttcctcttaatatttcaataatcagatctatcacgttgcaggcctttatgagtccctgctgtatttcttctttctcctgctcctttgcaagaagtgtctcatactttctttttgcaatctcatactggaaattgacatgatgccttattattggtacaagaccaagcgtctcaggtcttccatttgcgacggccagcatatttacaccgaaagtgtcctccagctttgtctttttatacaaaaggttcttaagtgcctcaacatcagcaccttttttaagctctaagacaattcttattccctctttcgatgactggttggttatatccacaatatccgttgtcgcttttgactcgacaagtgaatagacatcatttaagaattttcctatattggcaccaatcattgtgtatgggatttccgtaatgacaagcttgtcctttcctgccttacccttctctatttcgattcttccacggatttttatctttccctgtccggtctcatatattgctgcaagatcatcctgatttgcaacaatgcctcctgtcggaaaatcaggtccctttatatactgcatcatctcggcagtggtgatatcaggatttttcatataagcaatcacaccgtccaccacctcgccaaaattgtgtggtggaatgcttgtcgccatgccgactgctataccctcagcaccatttatcaaaaggttcggcaccttgaccggaagcacctcaggctcttttcctgtctcgtcgtagtttggaatgaaatcaaccacatttttgtctagatcagcaagatatgcttcctgtgtgattttttgaagtcttgcctcagtataacgcatggcagcggctccgtctccctcgattgagccaaaattaccgtgtccatcgataagtggcatgccctttttgaagtcctgtgccaaaacaaccatcgcatcatagattgatgaatcaccgtgtggatgatatttacccattgtatcaccgactatacgcgcactctttctatatggcttgtcgtacctgatgcccagctcatgcatatcataaagtgtacgcctttgtacaggcttaagcccatcgcgcacatccggcagggctcttgctataatgacactcatcgcatagtcaatatatgatttctgcatcagctccgaatattcggtctgtattatattgttgtctacattgttatctatatttctatccatgtctttctccgattataaatactgcttaactattcagaaccactgagaaccaaaagcagaagcgtcatgcttacacatccagctccgcgtcatgcgcatgctcgtatatgaactcttttctcggtggcacatcactacccataagcagtgatgtcacatcatttgccaggcgcccatcctctatttcaatacgctttagcatccttgttgcgggatttagtgtggtatcccagagctgatccgcatccatctctccaagacccttatatctttgcaacgtaaacttgcctgtatgtgtctttctgtacttgtcaagctccgcatcgtcatacaaatatttttcctcgccctttgacggaatagccttgtaaagcggaggcatggcaacatatacatgtccctctaaaataagctcaggcataaacctgaagaacagagtcaaaagcagtgtggagatatgagctccgtccacatcggcatcggccataatgatgattttgtcatagcgaagctttgttatatcaaaatcatttccatacccttctgaaaatccgcagccaaacgcatttatcattgtctttatttcagcgtttgccagtaccttatcaatacttgccttttcaacattcaaaatcttgcctcgaatcggcatgattgcctgaaacatacggtttcttgccatctttgccgagcctccggccgaatctccctcgactatgaaaatctcgcacttagaagcatccctgctctcacaatttgcaagctttccgtttgaatcaaaggaaaacttctgctttgtgagcagattggtctttgccttctcctcagcttttctaatctttgcggccttctcagcacatgatattaccgtctttaagacctcaagattcttgtcaaaataaagcggtacctcgtcatttgtcactttggcagtagcacggtttgcatcctgattgtcaagctttgtctttgtctgaccctcgaatctagggtcaggatgctttactgacactacagcagtcatgccgtttctgacatctgctccgttaaaattcgcatccttgtcctttaatataccaagctctctggcatatgaatttataatacctgtaaaggctgtcttaaagcctgtgatatgcgctccaccctcagaattgtatatattgttacaaaaaccaagtatattttcatggaactcgcttgtatactgaaaagccacctcaacctttatattctcactctctcctgtaaagtaaatgacatcatgcagcttttctatatttttatttaaatcctttacaaaaccgataataccctcaggctcatgatactcaatatgctctgtcgcatcgcctcgtttgtcctcgtatatgattgtaagcttcggattgagatatgcagtctccttcagtctgttctttacatcctcttccttgaatcttgtcttctcaaaaatctccggatctggcaggaaattaatctttgttcctgtttttttggttttgcctaaagtaggaagcaggccattttcaagctccacgacaggaacacccttttcatatctgtcatggtggatatagccatctctgcttatctccacatccatatatgtggataatgcatttacaaccgacgaaccaactccgtgcaggcctccactggtcttatatacagaattgtcgaatttacctcctgcgtgcagtgtcgagaatacaacacgcgcagcagatacacccttagcatgcatgcctacaggtattccacgtccgttatcctccaccgtacacgaaccgtttttctcaagagttacccttatggtatcacaggcacctgccagatgctcatctacggagttgtccacaatctcatatatcagatggtttagtcccttggttgtgacacttcctatatacatacccggtctttttctgactgcctcaagtccttctaaaattgctatgctcttctcatcgtatgtttgcttcttggccatacttgtctcctacttctttaaattgcgtaataattatattatctgccctgcctgctatccttgatatgcgctaacaccatcgtagctattttgaatatcatagcatcatcaaaggttctgatatcaagtcctatcgacttctcaatacgctctagcctgtacacaagcgtatttctatgcacataaagctgtcttgcagtctctgaaatgttcagattgttctcgaagaacttggagattgtagacattgcctcctcgtcatcaagtatctgtggcacctcatcaccaaaaacctcacggataaacatctcacacagactcattggaagctgataaataagtcttcctatgcccagcctgtcatatgccataatttccttttccacgtaaaacagcctgccgacctcaagcgccatttttgcctcctgataagactctgcaatctttggaagaacatccgtcggattgccatagcccacccgtaccttaatcatagcctctgcaagcagattgtcaaccagacttcctgcaatagatgaaagcttttcctgaagctttggtgaatctatatcctttaccagcactacattatgctcatccatcgccaccacaaaatcaccgcttctgatatctgccagattctttacaagctcaactgctatctcattgctgttctttcctgtatctataacatatactactcgttttctgttttctatatgtaatttcttggcacggtttattatatcagaaccaagcatattgccaagaagaatattctgaataaaattatttctgtcatatcgctctgactcaccgagcacaagtgtacgaagctgacaaactgccatcctgcctattacaagattctcactcgtatacgggcagaacattacgagcacatactcaagctctgaatcaatttcaaccgcaaatgcgattgcatcgtttttttccctaacatcatcttcagatactataaactccttcacaaaaatgtcgctatgttccggctcttccaccgtacctgtcagatgctttcccttggctgagtataaaatcgcatcaaacgaagtaatattttttatttcctcaagtgattttttcagtttctgattcgtaatcatattcttatcctctcattactgttctgacgcaggcaagtaaaaagcttccacaagtcataagctgtaaccctgctataatttaacaccgtaacttaacttttcagaacctcacacacattagcaaaagaaaaccgggtgtaaattatacacccggtctgtcaatttacaactatttaattttaacgaactagttggtaattgtcaattctgtttctttatcaaatacatgaatcttgtttggatcaaatgcaagctcaatgtgatcaccgtaacgagccggtgtatctgaatcaactcttgctgacatatttgcgcctgcaactgtgaagtataataatacctctgcaccaagtaactcatatcctgtaacatctgaatcaatcttgcatgtagcaaatttattaagatgctctgctgaatcgtagatatcctcaggtctgataccgaatactacgttctttccagcataaccgccatcgataagcttcttagcctttgcctctggaagctcaacctggtatttatcgaatttaaggaatgcctttgctccctcaacaacacactgagcatctataaagttcatctgtggtgatccgatgaatcctgcaacgaacaggttgtttggctgattgtaaagcttctgtgggctgtctacctgcatgataacaccatctttaagaacaactattcttgttccaagtgtcatagcctctgtctgatcatgtgtaacgtagatgattgttgcacctaatctgttatgtaatgaagaaatctcagatctcatctgtacacgaagctttgcatcaaggtttgataaaggctcatccataaggaataccttaggattacgaacgattgcacgacccatggcaactcgctgtctctgtccacctgaaagagcctttggcttacggtctaataatttctcaaggtcaaggattcttgctgcctcctcaacttttgccttaatctcatcctttggaacttttctaagcttaagtccaaatgccatgttgtcaaatactgtcatatgtgggtaaagagcgtagttctggaataccattgcgatatcacgatcctttggctctacgtcattcataacctttccgtcgatgataagctctcctgaagaaatctcctcaagacctgcgatcatacgaagtgttgttgattttccacatcctgaaggtcctacgaagatgatgaactctttatcttctacttcaaggttgaaatccttaactgcctcaaatccgtttggataaactttgcaaacgttctttaatgataaacttgccattttaaaaatacctcctaagtattatgtacatatatgtaactgttcagtgccctgactgtctgttaccttgtttctttgtatctttataatacaaaacatatcgtcaattggctatagtcaatccgccaaataatttaacgtgttgttgtcattatgacgaaatacagtctgatatcgaaacaattacaaggcaattactgcaataaacgtgctaattacagcttagaatatccaaagccattgaccatagcctcaatcggcagccccttcttgcagaatggacactctgtaacaggatatgtctggtagtttaccacatcatcatcatcgaacagcttatcaatctttactccattgacctcatcgatggttgagaatatggacgcaatacatgtgaccataccgccataatagttgatacactccatcgctcttctgattgtctcacctgttgtggtagttgccagaagaagtacaacatgcttgccatctatagcgcccttattgttatccctgaaaagcatctgtccgttgttaatctcaggcgatacaacgtaaattgtctcgtgcttattcacagacataagtccatttctctcaatctcctggcttaagaatgcaccaatcatttctgttccatccatacatactattgtatctatatatgaatgatgcggtaccttggtgtaaagagcctttgcagcttcctttgcctcggacacacgggtcttgatgcttgtcacatctacataataattaatatgcgaatgacttgtagcgaaatgtcccggtatagcatgtaagtttaagcctgcactctcctttgatttaaattttacaatacgattttccatgataagtccccctttttaagtaaagattagttttaattgtaactcatttgtgattaattagctcctgtagaaccgaatccacctgcaccacgcttcgtatcagaaagctctgacacctcattaaactcaacagccagatatggcatgaccacaagctgcgctatacgatctccgggattaatagtgcgtgcctgcgttccatcattgtgaagagctacaatatactctcccctgtaatcactgtcacacacacccacgcagtttgccgggcgaagtgcctgctttgcagctaaaccacttctggcaaaaactgccccaaaatatccgtcaggaatctctatcgaaagccccgtgcctatctttgctgtctcgtgtggctcaatgacaagctccttagtaatgtcggcatataaatcatagcctgctgcatattcacttccccttgtagggattttggctgtggttgtcaatttttttatatttattttcattttataatttcccctgatgtaattttatatatgaccgtctatagccatttattacccaacctattaactaattatttccactccagacttgagtgctcaatcttcctgtcacgaagcataagctctgagacagcctcctttgccggcttatcctcaaaaagcactctgtttacttcctcgataatcggcatccttacatcatatttttctgcaagggcaagtgcagcctttgctgaatagatgccctctacaaccatcttgacttcttttgttgcctcatccattgtgtatccctgacctatgagcattccggcctttctattacggctgtgacgactctcacatgtaacaataaggtctccgatacctgtcagtccaaaaagtgtctccgcctttgctcccatctcaatcgcaagcacagatatttctgcaattcctctggtaataagcgctgcctttgtattatctccatagccaagtccgtctgccatgcctgctgcaagtgctatgacattcttgagggagcctccaagctccattccaagcacatcaggactggtatacacacgaaatacctcattcataaaaagatcctgtactatctcagcggtcttctgtgtccttgctcctgcaacaacagtcgtaggaagcagctgtccgacctcctctgcatgtgaaggtccacacattacagccacatcagcgcaaggtatctcactctctaccacatcagatatggtcataagagtgttttcttcaattccctttgccacacagacaattatctgtccttccttcacaaacggagccatttttactgctgtgcttctggtgaatacagaaggtaccgcaagtacaagtatatcgttatctttgattgtttcctccatatctgttgtaaaggtaatgctatccggaagctttaccccaggaagcttatcaatatgctcatgcttttctttaagcatctcaatctcgctctccacgattgaccatatttcaacagaatgtccgttatttgcaagcaccagggataatgctgtaccccagcttcctgcacctataatacctactctactcattttctatgcctcgtattttatataattattataatcaaaaactattatttactttgccttctgaccaaatttattttcagttccgcttaaaagtctcttgatattggctctgtgtcgccagatagccatcgccgtaaaacaagcagcaagtatatcaaactcgaccgcataattgccacttactccaagcaaccccatatggttaaacacaattgcctgaatcagaaacgatataacaaccagtatagaaccaagcgagacatatcttgttatggctacagcaagaataaacaataccaaacatatcggagccgcaatcggacatacagcaagtatcacacctgatgtacatgctattccctttcctcccttgaaattgagaaagaacggaaaattgtgtccaagcaccgctccaaagcctgcatacagctctatgcatttaacagcctgtggatatgtatttctatatatgaaataaaatatcaaaaccgctatgattgccttgaacaaatcaccaaagaaggtaactgcaccggccttccatccaagtgtccgaagcgtattggtggtgcctgaattaccgcttccatgctctcttacatctattccatgtgccttaccataaaaatatccggtctgaaaggttccaaagaaataccctacgaccaatgctaaaatcctagccagtatcattttactcattttcctttcgttctcttgtaataaacttaagcgcagttcccctgaaaccaaatgtatccctgattctgttctcgagatatctggtatatgagaaatgcataagattcttgtcgtttacaaagattacaaaggtaggcggcttaacagaaacctgtgtcacatagtatatctttagtctcttgcccttgtctgtaggtggctgctgcatggcaactgcctccgtaactatctcatttaacactcctgttgcaacacgcattgagttattctctataacaacatcaatgagctcaaatatcttgttgagtctctgacctgactttgccgaaataaacagtatctcagcatatggaataaagcttaatatctgtctgattttctccgtgtgctgctttatggtattattatccttttcaatggcatcccatttattgacagcgatgatgattcccttgcctctttcgtgggcaatgcccgcaattttggcatcctgctcggtaactccctctgttgcatctatcactactataacaacatcagctctctccaccgcagaaacggcacggataatactgtacctttctatatcctctttaatcttattcttgcgcctaagaccggctgtatcgataaatatatactccctgccatcgtactttatagctgtatcgatagcatctcttgtggtgcctgctatatctgacactatcaccctgtcctcacgggcaagcttattgatgagtgatgacttacctacattaggcttacctacaatagcaactctcggtctgtcatcatcgtcatcctgctttgatgaatccgggaaatgcttcacaacctcatccagcatatctccgagtccgagcatagaggctgcagagataggatgcgggtcaccgattcctaagttataaaactcatacacatccgtcatgtacttttcaaagctgtccaccttattgacaaccaatacaaccggcttgtgtgaacgacgaagcatatctgctacctttgaatcggaatcaacaagcccctgcttcacatctgtgataaaaatgataacatctgccgtatcgatggcaatctgtgcctgctctctcatctgcgacagtatcacgtctccggattccggctcgataccgcctgtatcaatcatggtaaaattgtaatcaagccatgatacatctgcataaattctatctcttgtgacacccggagtgtcctttactatagatatcctctctcctgcaagcgcattgaagagagtcgattttccaacatttggacggcctacgatggccactactggtctgctcatatactctcctgttctaaattcatattagcttatagaataattgtaactattcaaaaataattataaaataataaacaaaacatctataacagagtaattatatcacaataccatttacagaaacaactattcatgtgtcaaaagtggttcttttgatgaaattaatccattttcttttagaacagctatcagattagtacagttttcaccaaaacttatgttgaccgaatatgtgtcaataccatcggaacgggcatccttaaaatcagaatactcccttgtcacacccagtatatctaacagctcctcataccatgaaaaaccatagtcaatcctgctttctccaatcctgttgccctttggtactgtaaaattcagcataaggttgtacatatagctgttatccttatccactccgtcaagcatgctctgcaaattatattcctgcatcacaccggcctcaacatccttcttcacagcctcaaaaatatcagcagcaacttttccgtcaaagctctcattcagcacatatacacctttatcattgtactgctctgccgagccattgataaaggtaatatccgtcgtatcgcactgcattatggcattaataatattctgtggtttattttcctctgccataatcgctttacactgcttgtgcggattaaaatcatctgttgtatgatatacacggttgactttttctccgttttttaatgtatatgagatagtaatatacctgaaatcattatatctctttttaaaataatcctttttctgcgccataagtatcttttgagtctctaaaatcttttcgacatcttttccatccagattgatatcaaaatctatgtctacacatgcagaatcaatatcagcaagcttagggatataattctcctgcatatttccgtaaaacgttatgcctccaaatacaactgcaacaaacacaccaaaagcaataatttccttaaataatgcttttgaaaaaatcctaaaattctttcttataatcatctccaagagtaagaaggctatgattccaagcactactgcaagcagcataattgcacaaacaccaatgcttattcttagcccaagcagcagtgatgctgtaacagtagataaaatcagtcctccaagacagcccagcacccatctgaaaaccggcttaagctttgaaattgcaataaaacttcctgcattttccaaatctctatgcttataaatcttataagaaataaagtatataactgcagccgcgataacatagactacgatagtatttgtgcctctgaaagtatatttaatacagtaataatcatctcctgcattcttcatggtcggatgaaagcctacccgattgagaagctgtagcatgggtgcaaaccacgtaacacttattttccttacaaattccatatatgaaagcccgtatgatacatatgtgagcacattggcaatagcaataactgctccaccatacagcagattgacaaccgcatacatcaccgctacagaaaccagctgtcctgtaatcattgcgcacagacacaccaggctgtacataaaaaaagatattcccattgtagcaagcagattgattccaatatgtaccaccttagtatttccatatgatatacatataacaaacgacataatgtacttaactatctgcggaatccacataaacagcagacctgtcaacacattagtcgaaaaaagctgacgtcttgtcacaggcatagcatgaatcatattacatgctctcgaattatacaggtaactgaacattgccatgcctgtaaccaatgccataacaaaaataaatatcatatctgcctccatgctgatagccggggacattatatcaagcatatacttatgccaatttgtgccataaataaattctgcactcttaaatctgctccacatggaaaacgggccgttaagtaatagcactattgtatacagtgtccagattggccagtaaagctttacattcttttgcagcattgttttattaataaatgatgtctttgacttcatagtcctctcctcccatctcatagataaatatttcctccagagtaagaggcagtacatccactacctgcggactgtccttgccatctgtaatagcctttacaacagcctcaggctctccacgcacaataactgtgtatactcttcctatatttgacatatgaagtactttaaaatcctgcggtatcttaggcatgccatatggacatgcaatctgaatctttgaaatattaccctgcagctctgtaagagagcgctctatcataatctttcccttattgagaatacctacatgatcacacacatcctccagctcgcgcaggttatgagacgatacaaccactgtagtattatttgcagccacatcatcaagcatgatagaccatatctgtcttctcatgacaggatcaagcccatcaacaggctcatcgagtacaataagctttggtttacagcacagcgcaagccagaaggcaacctgcttctgcatgcccttagagagctttctgatatttcttttaacatctatagatggaaaaaactcctgcatcctgtaaaactgcttctcatcaaaatttggatacattcccttataataatgcatcatattaattgtatcagattgcaaaaaataaaacatatcatccggaatgtaagccatatgtcctttaatccttgcattttcatatacaggctcaccatcaataaacacttcccctgcatcctgtctcattacgcctgtaatatgtctgataagtgtagatttgccggctccgtttgggcctacaagcccatagacagctcctttttccacgttcatattcacaccatcaagtgccgtaaaatcgtcaaattttttcactaaattatttatctgtatcatcattaccctctgtcacaacatcttctgtctgcatatcttgtgttacaaatctgactaagtcatcttccatgctcagctgttctttcgcatcatccattcttgttctcaattcctcaacaggtgtttcaagcacaaataactctgtcaccacctggtcaaatagtattttcaaattccttgtcatactctgcctggctgtcttagcatcagcaacaaaggttcctttaccacttttagtataaagatagccttcctcctcaagttccctgtatgcttttgcgatagtgttaggattgattgcatacttgcaggcaagcacacgtacagacggtagcttttcgtcctgcttaataacattcataacaatcattcgtctgatgccttccttaatttgttcataaataggctttgaatctcgataatttaactgcatatcgttctcccctgttcatatacgccagtaccgctgtgacttttatattaactcaaagaaccaaaaactgtctggcagcatcagttcccgcacagtgtactatccaacgtgatacacctattttaacacatatagctttaggcatttcttattatttccttaatagattgtgcgaaaattacttaagaaacataaaagctccaagatttccacgctttccatgacttgctctatgcgaaaataaaagagagggattacaacaagtgcatatattgcttatggcaatattgtcttcctgtactcctgccgccacaagcactctcctgttacattcccaaagattgagctgatatttgccgtctcccttatagagcagaatatcactcgcatgaggatcgtctgttgtcgcaaactcatccacaaaatgctctgcaacatcctgacttatctcatagcagtcctgacatattgaaggtcctatcgcagctataacatcatgtgcctcagtaccaaactccctgttcatagcaataagtgtctgttttcccatgcgatttacagtacctctccagcccgaatggctaagccctattgccctatgtaccggatcaacaaaataaagcggtacacaatcagcataaaatgtggcaagcacaacatttggctcattcgtgataagtccgtccacatctgtatatggtctctttcttgtcaccccgatgccacactgcttttttccaactctcaaaacattggtagtatgtgtctggtctgtcgtaacaatctgccctgcctctgctccgattgcctccgccactcttttatagttttctaagaccttttcctcgtcatctccacgtgtaaagcttaaatttaagctatcaaacattcctgtactgaggccaccaagacgtgttgtaaagcaatgctctatcatagaaagctcatttagcttcctaaaatgtaacaaaggaacaacacttccgcttgaaaggacgtgcttttttaattccagaacatctttatcattctttgtaacaaaatcatttatagtaatttcatcaacatttttgtgtatgttttcagcctgcatattcttatccatctttatattcttttccttctttatattctcatcaatctttatattcttatcaatgtcttcatatttatatctatgcaactatattttaccgataactattgctgtttataattgatatttatagttacttcgtaactattaagtacagaaatatgcggttgtgtaatacctgtccgtaactgccaagccaatagttattgactgccctcaaatgcattcttcaacacagtaacctcgtcatcatccactgctatcacatcaaatctgcatggtgtccactcatccaaaccatgtttcataagataataccttgcaactgatatgatttttttctgcttgctataaccaactgcttcaagagccctgccacagccgttatctctacgatatttcacctcacaaaaacatattgtatctccatcctttgctattatatctatctctccaaagcggtttctgtaattgcaggcaagtacactatatcccatatttattaactgctcagctgcaagctgctcatatatacttccaacacttcttttattcataactgcctcacatatcatataacctacacactatctttggtcaatttttgccttaagcttatccagatcattaacaaaaacaagtatctctgcaacaacctcatacaactccgttggaatcatatcacctattttaagcctagacagtgtatcagcaagcttatcgtccttatatgtaggcacattgctttcctttgccctctcaataattttgtcagcaataacgcccttgcctgtagctagtattttaggtgctgcttctcccggcacatactctatagctacggctgttttgcctatgtctattccattattgttgcgattatcattttcgccatgcatacaactcacctgtccttctgaagtaagttttaatcatctgtgactattcgtaaattatcttatacactgctacgccctaatgtcaaaagaatatctatgcacctgacctgtaggtggcaaatcctttttcagaaatccagcgacaaaattcatctgtttcgaaccactatttacattcaattcacaattatagcccttatcctgtaatctcttttccaacaccggcagaaattgctttaccagtgcatatgactcatcactatccaaatagaaattagttgtaaccttcctatgaagcattttaattgacacatccgtcccaccgagatgctctaaatccaaatgtaaaaatgctgataattctttgtccggattggacatacttttcttatttgtatacacatacaactgtccgctggcgtttttttcattcatcttcaatggaacctgcacatatgtatatgcctcgtttatctgattcataaattcaatatttccacggatattatctgccagtgcctctgctttaggattcaccactcctgatgttttcaaaatagtttccatatttgttatctgtttttcaattttgtcgtacaagccatcaagcttcttaggattcttctctaaatctcccggtttaatcatccattgctgttctaaagcctccttcaacataagcttaaaggcttctcctgaaaacaaatgtctcagtgtatcggcatttgccggtgtattttccaacatactttttatatcgttaagtattcctacgacactgctatcctctgaatacaaggaaatattgttttcctgtacattcggaagcagcatcctgacctgttcattaagctcttctatctgcttatccgataaaagaaatccaatagtatttgattttgtttcattctcctgtaaaaggatggtatctgttgccggagcattgtttattttctgcgttgtgtaaatgtcctgtgattcacctgaaacactgtttaatgattcaaataattcagcaatattaaagtgtttttttactacaggtgccgattgattatcacgcattattgcctcatactgtgacatatcagaagcttcacttgatataaatgtctcttcaggcagcccttctgtaacaatatttaaaatatccctcgcctgggttacaagcttatacattgataaatcttcggctgaaagagcattcggcagttcatctatcaaactatccatagcaattgtaatagcctgtttgtcattagcataattttcaaactgagctgcatttacctgattaatttcaattccaagcctctttaactcaacaagtgtagtcacattaatatccttattatcctgcacaagctgatacatctgattaaggcttgtcttatcaattggcatctgctcttccatcatcttgttcaccatcgacaaatttatgccatctaccggcagtcctgcagcctttagcgcatccataagtgtgaggttagctccctcgccatcaactgtatatggttttatttctatagtgcctccatcattatttttcacctgaaaaaacacagactgtccctgttcaaatgaaaactttcctgccagccttgccaaaatctgctgaccatttgacaaggcaagcttaacctgattgccacggacactgcttactgttccctcaaatatcatcccttttgacatttcatttaaagaagataccagcttttcaacgccctttgctcctgtcataggctcaccatttgccactgaattgttgtattgacttaccaaatttgatatctgcatagcatcaccctgatatagtatcgttatgtttaagtatacatgtataaattgtatcatttattggtatttctgtcactatattactgttcacacaccacagtataaccggcaacaattgatttctttcaaaaatcaggtaaattccaccatattcttcctataccactttggacaaagattgcgctgacattgtggattgaaccgctcccttatatcagtgtgctcaaaatacaccttccataactgctcaaaactgtctgtcttcaccggcacacttctctcaagctgtttaaattcactttcattgatataaaagcactccttaagcctcgggtggaccactgcataccttcttctatcatcatagattacaaaattttccccgggatacctgtccacaaaatgccacataacaaccggtatcatatcacattttggttcaaagtgcgccagcagatagtttccattatcactaaaacgaataaaccctcttatcttgtcagcctctttatttacctttcttgaaagttcaaatacctccataacatatttatcggtcatatgctccataatcctttgccccaccttaaatgctctgacaagaaatccaagcactattgttgctctattaccagaataatggcacaaagcatcaaatacagtctcatatatcttaaaaccaagcttcttttgaattgtcaaaattgtcttttggacctttacctcatctgtttcaatatctatcatctttgaaaaaagtgtatagtttcctccaatgcctatctcaatagaaatattgtcccggtatacttcgtgattttctttttgcatttgatttttgtatacaaaagcatcatatatagcggtaaaaatcccatttatattattatcacatctaagtattatattatccatgcatccttctccctgcagctttacaaaaatattgtctattcagatataaaatcaaatatactcatctgctcataagtacatgatttattatcagctaaaagcatagtatccggcctttcgttatatatgagatgccttgtaatatagctttcatcaagctttgtattgtacatcatacgaccatcacaggtgataaagtacagtgctcttttgagcacgacacccattttctttaaatctgtaaacgaaagctttgcatgctttctggcttttataatacgcctgacactgttagtgcctatccccgggaccctgagaagtgtataataatccgccgtcataatctcaaccggaaaacactccagatgacctacagcccactgacactttggatcaatataatcattaaagctctgattatcctccgacaaaagctctcctgccttaaagccataaaatctcataagaaaatctgcctgataaagcctgtgctctctctttaacggtggcggctgcccgatacccggtaatgactcatccatattaacattcacaaaagcagagtaaaatactctcttcatatcaaacctgttgtacattgcttctgctacagatataatctgataatcactctctccggttgctcccacaatcatctgtgtactctgccccgccggcacataatatctgtccggtcttttgatacttaagcttgattcccagcttttttcagcaagcctatctgccttctcacaatctgaagtaacccgaagccttctgtgatactctgacaatcttgcagcgctatcctttatttcggccatctgctcataatatgcctgctcatctatatacatacggtttttcatactgctattgccatgatacattcggctgtcctttataccattttgaataaatctcataggtgtaagaatgtttttacgcgccttattcggagcaactgccctaagcccttccgctgtgggcaactccagattaacactcatcctatcacaaagatatccaatcatctcaagaacctcagaggaggctcccggtatacccttgatgtgtatatacccattgaaatgatatttgtttctcagaagaaaaagcgtggtatataaaagctgcatggtatgctcgggcgattctatgatacctgagcttaaaaaaagtccctctatataattgcgtctgtaaaactcaacagtaagctcacatacctcttcaggcgtaaatgacactctttcaacatcattagtgcatctgttgatacagtatttgcaatcataaatacattcatttgtaaaaagtatcttgagaagcgatatacacctgccatcagctgtaaacgaatgacatattccactggcaaatgcactccccatatcatttccattacccgaacgagatgcaccactggaagtgcatgcaacatcaaactttgccgcatcagacagaatcttaagtttttccataatatcagcactgattgacgttaacataagacctcctcacattatatcgaacatctgtttgtattatataacatatgttcgggtaaatcaagtgaaaatttttggaaaaatattgttatggttcataaacacaaaaaccatagatatcttaaatgcattaagatactatggtttttatttataataattatcgtaactattcagttgcaaaaaatatcgtagcctttataaacagactttattccgactaaaaaaattttcttaagagctactgtatgacatgattttatcccaatttagtcttaaaaaactcgattatcctatcccacagttcatcctggaaaaactgcatatccgcatgatcagcgccttctaatgcaatcaaatctgcatcacagccattttcaataagcttgtcataaagctcttcactctgctcaaacggaactgtctgatcatttataccgtgaataatcaaaaatggaggagcatcttttgtcaccttagacaccggagaactattgtatgcttccttgatatttctcataatattatatccgagtaaaagtgactccatagatgctgcgcattcttcggcatctttatacttaaatgtgctaaggttagtaggtggataccatggacatgctgcctgaatactgcttgactcttcaagatattctccaacatcacgagctttatcatgatccaatgccgccatacatgtcaaaaatcctccggctgattctcccatcgcaccaaaatgttccttgtcaattctgtatctatctgcatgtgccttcaaatacctgattgcagccttcacatcctctatctgcataggatagcaaccctcatttgatgtgcggtattccacactgcaaacaacaaaaccctgatgagcaagcgtactaagatatgatagatgtgctgacttatcaatcctcatccatccaccaccgcatatccatactatacaaggataacgcttgtcagacatatcttccggatatattaaatcgagttttaaatccctgcgacagtgatcataccacgaatccacctgcgcatatgtaatatcagatacctgcacatattgtggcttcgtcacattaatcttaagtttttccttcatttcaaaatcctccttacatttgtaatccattttgaaatacaaaattaatatcatttaaaataaatactttatgcccattataatacatctattttcatttttaaacaaaaaaaccttgaaacaactatcttgcttcaaggtttaataacaggggatgagagaatcgaactcccgctaaaagttttggagacttctgtcataccatttgaccaatcccctatatttaaatattatatcaaatatagaaaaaggacgcaataggaattacgtcttattttaatgtaccttcaaaacttcatacaaatttaattactgtaatccataccgaaaaactcatctcgattccgcttcgcttcatctcgatggatttgcttcgcaaatctgcgtccaattaaatccagatttatgcagacacgtctgcaaaatccgtatttcattgtacttgtttttctttgttattaaccagattaagccctcgacctattagtaacagtcagctccacatgttgccgggcggattcgggactttaacccgttagaaacgtgcgccgctaggcgcacaagacaaaaaataccgtcagggaacatctccctgacggtatttttatttgacctgatttatttttacagtgccttgattctctcaagtgcctttactgtgttctcatagtttccgaaagcagtcagtctgaagtagccctctccgcttggtccaaagcctgagccaggtgtacctaccacattggcattctcaagcaggtaatcgaagaactcccatgatgtcatctgatccggtgtcttgagccagatgtatggtgcatttactccgccgtatactgtaaagcctgcctctgcaagacctgtctttattgtctttgcattgttcatgtagtatgctacctgatccttaagctgtgcttttccggcatctgagtaaactgcctcgcctgctctctgcacgatgtatggtgcaccgttgaacttggttccgtgacggcgtgcccacatagcatgaagtgatacatcaccacacttaagctccttaggtactactgtgaagccaagacgcacacctgtaaagccggcgttctttgagaagcttctaagctcgatggcacatgtctttgcaccgttacactcatagattgaatgtggcacatctgcttcgctgatatatgcctcgtaggctgcatcgaagatgatgactgaaccattcttgtttgcataatcaacccatacctgtaactgctcctttttgagagttgttcctgttgggttgtttggcagacacagataaatcatatccggtacttcatttggaagctccggaacaaagccgttatctgctgttgacggcatatagattacattgctccaggtctctgtctgagcatcatatgtgcctgttcttcctgccatgacattggaatcaacatatacaggataaacagggtctgtaacagcgatacggctgtttgctgagaaaagctcctggatgttggctgaatcactctttgctccgtctgaaacaaaaatctcatctgctgagatatcgcatcctcttgccttgtagtcgttgtctgaaattgcttttctgaggaactcatatccgaggtcaggtgcgtatccgtggaatgtagctgcatttcccatctcatcaactgccttgtacagtgcatcgatgatagcaggtgcaagcggctgtgttacatcgccgattccaagccttattatctctttatccggatttgcctcctgataagctgcaacctttttagctattgtgctgaaaaggtagcttcccggtaatttctgaaagttatcattaatctgaaacatgtttatctctcctttgttactttacaataagtctaatttatcactttaccatgcaagtgtaaatatatttttttatcattattttttatagtaactgttcaggcctttgcagctactatcatacgctcttctgtctggcttcataaaacgcacactacacctcagtcataaggcttagtatcatctgtgctgtttccacaagaccggtgccgttatccatgcttcgcttctggatataccggtgtgcttcctcctctgagaatccatttcgttccatcagtacagactttgcactgcttagcatctcctgatcctcctttgaacgtaccctaggcctttgcctgagctttttcctgcggcgcgttatcgtgtaatccatcatctcaacagtctgcaaaagctcatgcacttttagtggcatggataatgacatcagattatccacatttttttccatgatacccgctgccgacgctataagaagcatctgaaactccttaggcatatactcgtatatctcactgtacatcatgtctgaaaatctgtatccgcatatgatgattcccatattcagtccgttcatgctcgaaagtgctgaagctcctgtatttgcaaccgccgtgactgtataaccgctctgcgctaatatttttttgattgaattggctacttcctttttaggaaatgctataacaatattattcacggtttgttacatcctttaaaatttgtacagatattcatctatttcccattgggtaaccgcagctctgtaatcgttccactctgcctcttttgcctctatatacttgttgtagatatgctctccgagtacctcgcggataaaatcatctgacttaaggcactcaaccgcctcatgtaaatcagcaggaagtgattcaattcctagtctctttttatcctgttctgtgagctcaaatacattctcacgaagctccgcatccggctgtaccttgttctttatgccgtcaattcctgctgccaggcacagtgccagaaccagatacggatttgctgaaggatcagggtttctaagctccactctccttccctcacctcttgctgcagggattctgataagcggacttctgtttgtagctgaccaggtgatataaatcggtgcctcatatcccggcacaaagcgcttatatgaattgacgattggattggtgatgaccgtcatgcccttcatatgcttcatgataccgcctatgaagtagtatgcctcctcgctgagtccaagcttatcctcctcattgtcaaatatattgacaccatcctttgaaagtgacatgttaatatgcattcccgagccgctcacaccatgctttggctttggcatgaagctggcaaaaagtccgtgccgctttgcgattgtctttatagcaagcttaaaggtcatgatattgtcggcggtatgaagtgcctcctcatacttgaaatcaatctcatgctgtgcaggtgccacctcatgatgtgatgcctctatctcaaaatccatatcctcaagagttagaaccatgtctcttcttgcgttttctcccaaatcatttggtcccaagtcaaagtaccctgctctctcatgcgagatggttgtaggctgtccgttctcgtccaggtggaaaaggaaaaactcacactccggacctacattaaatatatagcccatctgctttgccttttcaatctgcttctttaatatatagcgcgggtctccctcaaacggtgtaccatccgccatatagacatcacagatgattcgtgcgaccttgccctgctgtggtctccatggaaaaatcataaaagtgtcaagatccgggtgcagatacatatctgactcctctatcctcacaaagccctctattgacgagccgtcgaacatacacttgttgtcgagtgccttctcaagctggctggctgtaattgccacattttttaatgttccaaagatatccgtaaactgtaaacggataaactcaatatcctcctcatccactatgcggataatatcattcttactgtattttgccattttaaatctccttattattgcaaaaagctataaccttatcgtactccatctcaccgccaaacaaatcaagagcactgcctattgtcacattcagatgattctgtccaagctgcctgatgcattttaaatcgtcaaatgatgacacaccacctgcatatgtgaccggtatccttccccagctgccaagcatggcgacaagctccttttcaatgccgttcaccctgccctcaacatccactgcatgtaccagaaactcgcagcaatatgaggatagcttatccaaaagctctgtggtcactgcctcatccgtgaagttttgccagcggtcagtcactatataatactgtccatcctttttgcgacacgacagatcaatcaccagcctgtcactgcccacagtatctttaagcctgtttagatttgcatagtttatcctgccgtctttaaatacgtaggatgtcacaataactgctgttgcaccggcatctataaactccatcgcattgtctgcggtgatgccgccacctacctgtaagccctgcggatacgcttcaagcgccataacagcctgctcctttgtatcctcataatactcgctgtccacagaattgagcagaatgatatgaccgccctttatgcccgatttcctatacatatctgcataaaaccggctgtcctgctctgagacgaagttctcactggcaaaatcgcccctgtcttttaatgaaccaccgacaatctgctttacttttccattgtgaatgtcgatgcatggtcgaaattccatatttttctccctggtttagtttattgtggcacaaaaatcgttactgtccacgccttagcgtaacatgcaaacattgccttaaagccacctaatataaaatataacataatttttactttatttgcaaaagacttacattagttttactaataaataatataataatttcatatcgggcttataactgcttgacacccactctttaatttgctatcatcatacaaattacattagtatataaagtataccagtataataacataagaaagagaggaatttaaaaatgggtactattatcggcgaaggaattacatttgatgacgttctcttagttccacaatattctgaggtaacaccaaatatgattgagcttcagacacatcttactaagaagatcgtccttaacattcctatgatgagtgctgcaatggatacagtcacagaatcaaaaatggctatcgcaatggccagacagggtggtatcggaatcatccacaaaaatatgtctattgaggcacaggcagacgaagtcgataaggtaaagcgttcagaaaacggcgttattaccgatccgttctatctttctccagaccatacattacaggatgcagacaaccttatggccaagttcaagatatcaggtgtgccaatcacaaaggacggcaagcttgtcggcatcatcaccaaccgtgatctgaagtttgagacagacttcacaaagaagatttcagagtctatgacttctgagaatctcattacagctcctgagggcatcaccctcgatgaagcaaagaagattcttgcaaaggcaagaaaggaaaagctccctatcgtagacaaggactacaacctcaagggacttatcactataaaggatatcgagaagcagattaagtatcctctttcagcaaaggatgatcagggccgtctcctctgcggtgccggagtaggtatcacaggcaatatgatggagcgtgttgatgctcttgttaagtctcatgttgatgtcatcgttgttgactcagctcacggacattcaaagaacatacttgaggctgttaagaagattaaggctgcttatccggatcttcagataatcgccggaaatatcgcaacaggtgctgctgccaaggctcttatcgaggccggtgcagatgcagtaaaggttggtatcggacctggttctatctgtacaacacgtgtcgttgccggtatcggtgtaccacagattacagctatcatggactgttacaaggttgctaaggagtatggagttcctgttatcgcagatggtggtatcaagtactcaggtgatatgacaaaggctctcgcagccggtgccaacgtatgtatgatgggctcaatgttcgcaggctgtgatgaggctccgggaaccttcgagctttatcagggaagaaaatacaaggtatatcgtggcatgggttctatcgctgccatggaaaacggaagcaaagaccgttacttccaggagggcgctaagaagctcgttcctgaaggagttgagggtcgtgtagcttacaagggaactcttgaggatacagtattccagcttgttggtggtatccgctcaggaatgggctactgcggttgcaagacaatcgaagatcttaaggagaacggacagtttgtcaagattactgctgcttctctcaaggagagccaccctcatgatatccatatcacaaaagaggctcctaactacagcacagacgataaataaacacatttattaattcataacacgaggtaaaatatttggacgctgacgacatatcgcagattatattcttattaatactattagcactctccgcatttttttcatcttcggagaccgctcttactaccgtaaacaaaatacgtatgagaaccctggctgaggctggcaacacaaaagccaaaaaggtgctcaaggtgactgagaactctccaaagatgctctcagccatccttatcggcaacaacatcgtaaatctttcagcatcatcgctcaccacctcgcttgccatcaagctgtttggcaacgtcggagcaggtgtcgcaaccggaatacttacattcctcatactgatcttcggagaggtctctccgaagacacttgcgaccataaaggccgacaagatttcactctcaatcgcaggctttatatcagttctcatggtagtgctgacacctgtaatatttatcatcaacaagctttcactcggagtcattttcctctttggaataagacaaagcgatgccaagcgcgtcatgaccgaggaggagcttcgtacaatcgttgatgtaggacaggaggacggtgtcatcgaggatgaagagcgtgatatgattcacaatgtattcgattttggcgatgccgaggccaaggaggtcatggttccgcgtattgatatgacgtttgtccatgttgattctacttatgatgatttgatttccatattcagagaggataaattcaccagactccctgtgtatgacgaaagcactgacaacgtaatcggtattgtaaatgtgaaggatctgctgctccttaaggatgaggataaagagcatttttccatcagaaatatcatgcgtgagccttactttacatatgagcacaagaatacagcgaatctgtttctcgagatgcgcgaatcatctatatcgcttgccattgtcttagatgaatacggtgtcacagccggactcatcacacttgaggatctcttagaggagatagtcggtgagattcgtgatgaatacgactctgacgagcaggatgatatcacaagaataaatgactacgaatacatagttcttggctctgcaaatctcgaggatgtaagcgatgagcttggtctacacctcgaatcagacgactatgacacaatcggtggctactgccttgaaaagcttgaccacctgcctgaaaaaaatgaaataatcatcactgatgacaatatccttctccgcatagaggctgttgataaaaaccgaatcgaaaaggtctatatcaaattgccaaagcctgccgaagaagagaattaaattcaggatcgtttaaccagcgggagttctccatgagacctcctgctttatttttgctgtaatacaaataccattcttcatacattagttatcctccattggctgatctgctacaatagtctttttgcagcttattttctttgtcacacctgtaggaagcttgaactcttcctctattcctgctgaaataatgcccttttccatatcacatacatagactgtggcaattacagtaccgcctgctgtaagtctctcattaatgtcctctatgacagctttttccacatcatagctgctgacgggctttttatccacgatatacatattgggctcgtaatatctgttcatagcacccgaaagtgctaatgacagactcttttccatctggttctccctgactgtcatattgtatacactaagcccaagcatcgctgtatacactacaataagacagcctattattccaagtactacatttttcattctatacgcctgctacctttctattaattggaacacttatcctcacatgatcccttgtgccatcatagaggctgttgataaaaaccgaatcggaaaggtctatatcaaattgccaaggcctcccgaagaagagaattaaattcaggatcgtttaaccagcgggagttctccatgaggcctcctgctttatttttgccataatacttttcgcttatgaatctaatctttccaaaggctttggttctctccttgacctgagtatctgtaaatgtgatggatatagtcttttgcgtgatatttccatagctgtcctttgcctcaagcactatctctatgatatccttgtcacgtgcactttctattttacggtcatcaaaatttttcactttcagataatttatctcgttatcgccaaacgcaatatcaccatcctccacatccgttgcagatataaggcttcctatcagctgctctgttataccgccattccttgcctgctttatcgaaaagaacatatcatccgcctctatggtaggctcatgctcccaaagtgcatacatacgtattaccgccttatctgtatactctatccccagtatcctgcataaatcagctacctgtatactctctcccggcgtatattttatatcaggatactcttctcctaaaatccagcctatacacatatgctggcttggcaatgtcaccgtatcactatacttcacagtggcagatacaccggtgtcatattctatgatatactcgttttcctgccatactgcgtatatatttttcgatggtctgtttgactcaatccagctgtttgccacaccacacaataacggatatacggcagtcgtatcatacgaattatttccccagccattcatatgatacccggccatctgccagcccacagccggaaaagcctgattgatgcctccatatgtgtagctctttgaggtcttttctgaatcagacgcactcgtattccgccagaatgtcacatctatagtacctgcctttgcgtatgccgtataagtaccacccgaattcacataaaaaccatatgatgatgagctcatcgacgaatcattgttccaattcgtgaaatcatatccggcagaactgcttgcactgattgtcacatatgtaccatagcagtatgtacctccccctgatacacagcttatgcctgtggactttctgacatcaattgtatgaaacagtcctctcaccgtcttgccataatacgaatacagtgctgagagtgcgctgtccgtccagtttgccgctttggatatacctgcatatgtagtataaacctttccccaggagggaccattatcattcatgccacccttgttcttgccatttactcgaagcaccatgcaggcatcgaggatgatggtacatgagccggagctaaggacattgagggcctgcgtactcaatctctttctcattacattcaaagaaattgaatacataagatattccttcccatttgactttgtctgatattttagtttcatatactttccaggcatttgataatagactgtctgaattacatttccactggtattttttacactaagcttatatccaattgtcctatattttgttcctgaagtagatatatttcctgccgaacaaaaataaatttctccatctgatttactagttggtttaaaaacggcactattaccatatgtattataaaacttgacaggctcgctccacacatcggcaaaaatatcatcgcaagcataattaataagcatgaacattaaggcacatatacctgctattactcttattatataatttttcatatttttcctttgcaaacgttaattaattgttgtccaattaaaatattccagcttcccacatataacaaatcagataaccatactcatcatattcccctttagtgtataatccagtaaaattatagaatccattgctttcatccaatgctgacttataatctggaatatcattctttgaaggataaatacatctgtaagcctctgaaacacctgctgaacacatctctaatccccattcattttttaccttttgagcaaataaatctgccagttctccctcagatatacttccatctgtccactgttttaccaacgaatcaatatacgccttctgctcccctgtcatgccatttccagccttactgccataaaatatccatcccggtgcaacatactcattttttggtgcttccggctgcgcaggctcactttgagccggctcaggtgcaactgtctgatttgatgctgccggttttgaatcgttacctgcaggttgttgtgtgttattgctgcctgtcgatgtctttttatctgctgctgttttgtcttctgatgatttgtcagaagatttatctgacgctgtatttgcattatctgaattaccggctgccggtgcggaattatcattggtatctgattgcgtaccgttattttgcttattatctttatcaactacatttgtttccttcaatgcatcctttttcacaagctcaagtgtctcgctttcagctacaatatcctgcgtattttcagtcacactgacagaccgggaatcctttttcttccccttttctcctgattttgagcttactgccactgctatacatatgataagaattattgctattatcactgccggtataataaataaaagtctgtgttgtttttcatttttcattttatatatccgctacctttctattaattggaatacttatcctcacatgatcccttgtgccgtttttgcagcttatcctgacatgcatatcatacacaccataatccggaaagctaagtgacgagccatcggctgatatgctgcctgtacagtcatttctgtccgaatcatacagggcataaacttcaagcttatccagattatcctcatgcgctgtaacatcaagcaggtcatatacactgtagcttacggcattctgacgcattttctcctttagctcaacacccggaaccggtatatttttcatgctgtcatagctgtcgtttgcgctatcgctgctcaatatatcctgtggcgcaaatgccacactcattttgttcttcagagccccaaatcccgacagcagcgcaattcccacaaccaccgccactatcatggctccatatgtctgcattatctccttcatctatagtctcccgattatttaaattgcactgttaccccatatatttataagctgcgcaagcatgcctccctgagccagcacaatatttcccatcaacacgagaaatgcacttgtggcggccgctgcaatcagcacgcctccatactgtctgaatacttctttcattttctcttacctttacatactttttaatcaattcagttactatcacagcagagcagacacatacacgagcacaccgattactccactgcctaaaagaagcataataacgcttcctcccaattcttctattaaaagctccatctgttttcctcctcttatacagccatatccacaagaaaagtactacaacgcatatccgctaagcacatgctcctgcttaattccgaaaaatgctaccgcgtaagtgaacttaagctccactcttgccttttctatctcatctgacgaagtgatttgtgatgcgtctgtgactgtccttatggaattgtctgtcatatacagtttaagctccagtgtatctccggcttttgatgcattttcaaagcaggtctgcgcaaccgaactgtcataatcactgtcctcaagctcattaataatctgcgcatgcaggttctgtgcctcaacgacagtcataaatcccgacagcacacctgatgatgtaaccaccataaacataatcaaaaacacccctaaaaaggtcttcattatctgactcacaacacaccccctacactaccttgtatgataaaaagcttataaggaaaatagccatatcaactatcatcttaaatgatgctgtgataacaggggccaaaaacaaaagatacatgccggcggtcttatccttaagcctcgcggtgtctgctacatcaagcatctccagattcttcgtaatcagctcatcaatctgacttccgcaattaccactatttccaatcgaaacagcatacagcatgcccatggctgcgtttatctccggcaggttcaaacagtcaagaaatctgtgatacgggtcagagctctccggctccacgtccagtctctccacaagcgtatttacctcttccttaagtatcaccggtatatgctctctcgacttctgtatggctacctgcacattttcactctgaatcagtagggcgaggtccatcagccacttgggaaatgcactctttacatccgctatcagatttttcttcataagcctgtgacctatacggtgctgattcagacatataagagctgctcccatagctgccacagccgcccattgtctgtcagtatacagtaaaaatgcactggctaacgccggtataactgccataagaattgacgcacgaagctcctttgccggattgtatgtcttgtattcctcgagctttttggcatgcttatcatcctccggcagcagatcaattccaagataatccacttcaagaaatttctgtccccagagtatgattaaatcatcaagcactataagagctgcagacagtatctgcacaatgatattgctgctgatatccatgctcaaaaccggtagataaagtatgattccactaatgataacagaggtcacaactgacaggataatctgatgaaacatcctctgtctgtcctttatattgcgcagtatcctgcgctcccatgcactcttatccttaagcagtatcctggctgattctttaatatcaccgccatagtactcagcgtgtgccataaactcgtgtgcatttactattcggttgcacttgtactcatcttcaataatcctcatagcatccacaaacacctctgtctcatcaaacgtgagcatcatatgatcaagagccctgctcacagtctccttcatatgaccatctgccagtgtgctctttacatcctcaaatgcacggattatcttctgctccttcaaaaatgaatacagcagggtgtcaatatacagcgatacatccagaaagcgctttcgcgcttcctgaaatctttggcctttgattcggtgaaaatgctgcataacaagaagaaaaacaagtaccacagctgtacacacccagtttagcttgagcagaagatgcagcacatatgtcagaaataaaatcaatatatacgtcattcctaagcctccctcccctcactcatcatggcctcattcatccgtatctcattgacaaaggactcgccaaacggctcattcacaccctctcttttaaatctgcgaagtatgacctttggtatatcgtgagtcactatctgtccgtctgatacaagcataaacacatgattggtatagttttccctgtagaaaaagcatacctgatctatgtatctgtacactactccgtcttcatttcttctcttgcggatcaaaattcccacatcaagtgcctgatatatgtcattctccatacgctctgcatccacacggctctctagcatattgagtattctgtccggtatattgcgcacatcatctgtgtggagtgtcgtcatgccacgcacaccggtgctccagctctgcagcagatattttacctcctttgagcgtgcctctgagagcataatccactttggattcattctaagacatgacttgatagcctcagagtagccaaacacatcctcactcaccttcatctctatacagtccttgcccggatttgtctcggcataacgtatctcaagagtatcctcaattgtaatcacgcgctcattcgccggtataaactgtgaaaaaaacttcacgcactccgtctttccgatgcccggcatcccgcaaaaggtgatattcatcttggtctttacacagtttatcagtacagctaaaagctcctccgagcagaatttctcagcaattgcagattctgctgtcagtctgataagcggcggtgtctttcgtatgctgatgctcctgcccgacttcgcaaccgattcatgcagtatcgtcacacgaagctcactcgtctcggcctcaagctccggatttctcttattgaactgtctgcttacgacattggcgatgcgctgtgtaaactgctccacaaaagcaggtgtcatatactgtgtgacaaactgctgattggccctgaaacgctcattgaatatatttgtaagccatatttctttgccgttataatctatatccgttatctcgttgctggctacaaagctccaaagcggtccaaaatattcttttccaagctccatgtaccacctcttatttgacactcatattggcatgatttgaaaagtttgtaatcagatcactaaatgtctttcctactatgcctgttgcatcagagcctataactgctgttacaacaaggatgattgataaaattgctacaactgttatgagtattccgccatattcctgaaaaatttctttcataatatttaaatcctttcttcatctaagtctaaaataatagtgttaaataaaatcaaaaatcaaatatatgaaactaacaatcaaggaaaaaaaatagtggccgaaatgccacaaaaagaaacctgcatagaacatatgcaagacacaatttaaaaagatatttatatcttacacaaaaatcgggatttgtaaataccaaatcccgaaaaaatgtgcacaaatattcatttagtttttatacatatatcacatacttattttagataaatatgccaattataagtctacccgttaggacataacagagaattgcacgtctgtccgttaagacataacagtgattttatgcctcgagcagcttatttacgctgacaagacgtgtgacaacaacaaacacctctgcagcctttttcagctcatcaagtgatggatatgtcggagcaattcttatcacgctgtcatccggatccttcttgtaagggaaaggagagcctgcacctgtcattgtgacaccagcttccttgcactttgcaacgatttcctttgcacagcctgaaagagcctcaaatccgaagaagtatccaccaagcggcttaacccatgttccgatgcctcttgaagcaatttcatctgtgaggatattctcaaccagctcgaatttaggtctgataagagctgcatgctttgccatatgagccttgataccatctacatccttaaagaatctcgcatgacgaagctgattaatcttgtcgtgtccgattgtctgtatagtaaggcgcttcttaatatcctcacggtttttctcagatgtgcatataccagccacgcctgcaccagggaatgtcaccttacttgttgagcagaactcaaataccatatcagggtttccctctttctcgcagagctcaaggatatttggaatctctgcctgcttatcatcatagagatgatgaactgtgtatgcattgtcccagaagattctaaaatcatctgctgcaggcttaagctttgcaaagcgctcaactgtctcatcagagtatacaacaccctgtgggttagagtattttggaacacaccagattccctttacagaggcatcgttattgacatatttctcaaccatatccatatcaggaccatcctcagtcatagggatgtttatcatctcaactccaaactcctctgtgattgcaaagtgcctgtcatagcccggtacaggacagaggaacttcaccttgtcaagcttgcaccatggtgtattgccgcaaagaccaaagataaatgcacgtgcaacctgatcatacatgatattgagactcgagtttccatatactatagcctgctcaggctttgctcctaccatgcctgcgataagggcctttgcctcaggaattccgtccagacatgcatagtttctcacatcaagtcctgattcacttttcatatcactgtctgatttcaagatatcgagcatagggagtgagaggtcaagctggtctgctcccggctttccacgcgacatgtcaaggcttaagccaagattcttaatcttctcgtactcagcctcaagtgctgtcttttcctgcattaactcttcctttgtcatttctgtatactttttcatttaaagatcctcctggtctgattttctaaatatttatgttattatcaactatttgcaattattcaagcttcatctatgcactttcatgtatcacagtctctgtgaagctcatccatgtgtgcttttatctttgcctcatagcctatatccgtaggcttgtaaaacactctgtctgtaaggccatccggcagatactgctgcttcacatagtgatttggatagtcgtgtgcgtatttgtacccgactccgtgcccgagcttttctgccgcaccataatgggcatcctgcagatgtgccggaacagccggtgtcttagtctgcttcacgcagctcatcgctgccgatatcgcattatatgatgcattgctctttggcgcgcatgccatgtatgtgacagcctgtgacagaataatctgtgcctccggcattccaacgcgctcgacctctgccgccgccgatgccgctacaaccatagccatcggatctgcattgcctatatcctccgatgcaagtatcatgattcgtcttgcgataaatttcacatcttctccggcataaagcatcctcgccagataatagaccgccgcatccgggtctgagccgcgcatgctctttataaaagcagagatggtatcgtaatggttatcccccttcttatcataggagataactcttttttgtatacattcgctcgccacatcgatagtgatatgaatgatgccatcgtctgacctgtccgtggtcagtacaccaagctcaatcgctgtgagcgccgctctcgcatctccgtttgacacatctgcaaggaaatcaagtgcatcatcatctatctgtgcattgtatgcacccatgcccttttctgtgtcagtcagtgctctcttaagaagaacctttatatcatccgttgacagctttttaagctcaaaaataactgagcgtgaaagcaaggctccgtttacctcaaagtaaggattctcagtggtagctcctatcagaataatggtgccatcctccacaaacggaagcagataatcctgctgccccttgttgaagcggtgtatctcgtcgataaaaagtatagtcttcttctgatacattccctgattattcttcgcctgctccacgacctcttccatgtccttcttgcctgcagaggttgcattaatctgcataaactcagcactggtagtgtgggctatgacctttgccaaagtagtctttccggtgcccggcggcccgtaaaagatgatggagctgagcttatcggctttaatcgcacgatacaaaagcttgtccttcccaactatgtgctgctgcccgaccacctcatcaagtgttgtcggacgcatccttgaagctaagggaccgcttgtctccttattctgttctctcatgtaatcaaataaatccatatcatccccgcctgaaatgcatatttgatatacctgttatatcattttgcaatttcttttagcaaaaaattcattttgcattgatataatcggcaattacgtgttttataagtgctaattatgcataaaaaagtggtgcaaaattcatttccctataataagatacatgaatttgcaccactttacaacacttaatttatttttctacgaaatgactaatatttgccctttaatgcaggataaaactgcttaaattttgcatagcccttctcatatttttcgacaagctgtggacttggcatggttgtatccttctttctcacaatagccgctgccgcagcctccacattttcaaagcagccgtttgcaactgcagccagtattgcaccgccgtatgccggtccttcctcgacttccaccgtgtcaacctgcatattcataacgtttgcaactatctttctccaaagcacactctttgcaccgccaccacagattgttgtgctttttggtgccacaccaaggctctttgccacctcaagtgaatcacgaaggccatatgccacaccctcaaacacagcctgcagcatgtcggctctgtcagtatccatgctcatcccgataaacgctgcccttgcagacggatcattgtgcggagagcgctctcccatcagataaggcagaaaatacacatgattctcaccaagtctgccatcctcctcaagaggcttctgctcattcacaaagtcatcggaatgaaggatatccttcatccaccagttgttgcagcttgcagccgagagcatacagcccatcagatgatagccgccgtcagcatggtcaaaggaatgaagcgcattgtgcgaatccactctgaactcatcacttgtgataaaaagagtgccgcttgttccaagagagaggttgcactttccggctccgactgtacctgtgcctatagctgcagccgcattatctcctgccccggctgcaactatgcagtctttaggaaagccaagctcacatgccacatcagctttcagagtgcctgtcttttcactgctctcataaagcccaggaagccactcctctcttacatcgcatatgtcaagcatctcctttgaccagcacttatttttgacatccagaagaagcattcccgatgcatcagaataatcggtactaaatacacctgtcatgcggtatgcaatataatcctttggcagcataagcttttttattctggcaaagttttccggttcatttgcttttagccataaaatctttggcgctgtaaatccggcaaacgctatatttccggtgagttcagacagcttttcttttcctattacattatttaaatagtctgtctccttctgtgttcttccgtcattccaaagtatagcaggtcttattacattgtcgttttcatccaatacaacaagtccatgcatctgaccgccgaagctgattcccgcaacagcgctcctgtcaaaatctttagtcagctctatcagcccagccacggtctgctcccaccagtcacatggattctgctctgaccagcccggttttggaaagctgattggatactcctttgagactatatttaatacctttccgctctcatccatgagcagaagctttactgcacttgtgcctaaatccacacctatatatagcatatctattctccattcacgtaatatgtttacatcagataacgtaactattcagaccccactaacagaaaggattttctgtcttgtatggcagtgatgccggctgattgtagttaatatcctctactggcacgccaatatatttaaatacctcaaaaagggcttttccgtaatgaccgaaggctacagctccgtgatgaggataattcttctcaataagcacatgacggtagaaacgtcccatctcctttatcgcaaacactccgatactgccgaatgagcgtgttgcaacaggaagcacctcaccctgtgccacataggcgcgaatcttacagtctgctgtagactggagacggtaaaatgtaatatctcccggcactatatctccctcaagtgttccgtttgtcacctctataggaaggcttcttgccataatcatctgatacttcatctgtggattgcaaaccttgcttgaacatgtgtttccacagtggaagcccataaatgtgtctgtatgcttgtagtcaaatctgccctcgattgactccttgtacatatccttcggcactgagttgttgatatcgagaagtgttaccgcatcctcgctgacgcaggttccgataaactcactgagcactccatagatgtccacctcgcatgaaaccgggatacctcttcctgtaagacgactgtttacatagcatggtacaaatccaaactgtgtctggaaggcaggccagcattttcctgcgattgccacatactttctgtagcccttatgctcatcaacccagtctaaaagtgtgagctcatactgtgcaagcttctcaagaatctcaggctttttgttgccctcgccaagctccctttccatatcctttaccacatccggtattctctcatcaccggcatgcttgttaaatgcctcaaacaaatcaagctctgaattttcctcaatctcaacacccacgttgtagagctgcttgattggcgcattgcatgcaaggaaattgagtggtcttggtccgaatgaaataatcttaagattattaagtccgtatacagcccttgctattggcaggaattcatgtatcatatctgcgcagtcatctgcatcgcccacaggatactccggaatatacgctcctatatttctgagtgccagattgtagcttgcgtttaacataccacagtatgcatctccacgtccctgaattaagttctcctgtgtctcctctgctgctgcaacaaacatctttggtccgtcaaagtgctttgcaagaagagtctctgaaatctccggtccaaagtttccaaggtaaacacaaagtgcattgcagcctgctgcctttatgtcctcaagtgcctgtaccatatgtatttcgctctccacgatacatacaggacactcgtatatgtctgctgcatcatactttgcagcgtatgcatcgacaagtgcttttcttctgtttactgacagactttccggaaaacagtcacggcttaccgcaactataccgattttcatttttggaatattgttcatagtgtaaatctccttctctcatatgccccatcggacagattaattgttcttatgtgctaagtatatatccggtccagcttaattgatacctataatttagtaaatttagtgtatttttcaacttaatttactaaattataatgttaatactatattgtcatgttataataaggcaaataaaacataaggagctatgccatgtctatcacagcaaaagaacttgccaaacaacttaatctttctgaagcagctatatcgatggcacttaataataagcccggtgtcagcacactcaccagaaaacgtgtgctcgaagctgcggcctctgccggatatgatttttcaagaatatcaaataccaatgaagctccggcctccaatggcacattatattttgtaatatacagaaagaatggcgctgtagttcctaattctcctgtttacacacatacagagcacggcgttttggtacaggatgttccattcttttcacagctgtcagagggtattgatttgggctgcaggcactgccactactacctgaatatcagctacatatacgaaaatgacgatattgaggctttgctatctgagtggaaaaggcttggagcaaagggtatcctgctgcttggaaccgagatggaagagcatgacataaagccctttacaaggtgcggtctgcctgttgtgctaatagacaactatttcgaagccttaaacctcgattgcgtgactataaataaccttcagggtgcctatcttgccacagactatctgatcaagcaaacacatgcacagcccggatatctgcattccgcatacagtataaccggctttgaggaaagagccgacggcttctataaagcaatacgcaaaaacggtatgtcaacctcgcgctcagtcgtacatcacctctccccttcagttgacggtgcttactgcgatatgaaggcagttataaaaagcggtgatgaacttgtccgatgctactttgccgacaatgacctgattgctgccggagctatgcgtgcactttcagaggcaggctaccgtatccctgaagacatatcagtaataggctttgatgatatgccaatgtgtacctacattacaccgcctctttcgactgtgcatgtgccgaagcagtacatgggtgaaattgcagtaaaaaggcttgcagagataataaattctacctctgcaagccatgtaaaaattgaaataagtacagaaattgtaaagagaaagagctgttaatttctatgcattcacttatgcatttttctgaactgccgatgcactaagtttgccatccttcacatctataagaatggtatctcctgctctcacaccatctgccagaatcagctttgccgcgagtgtctcgacatgcttctgcagatatctcttgagtggtcttgctccgtataccggatcatagccattgtcggtgataaactgctttgcagtgtctgtcagctcgactgtgatttccttgtcgacaagacgcttgtttaagtctgccataagcagggtgatgatatgaccgatgttgtcctttgtgagaggcttgaacatgatgatctcatcaagtctgtttaaaaactccggtctgaaatgacccttaagctcatccatgacgcggttctcacactctgtgctgatgctgccgtctgcctctatgccctcaagaagctcctgtgagccgaggttacttgtcataatgatgatagtgtttttgaaatccacggtacgtccctgtgagtcagtaattcgtccgtcatcaagcacctgaagcagtacgttgaatacatccggatgggctttttccacctcatcaaagagtactactgagtatggcttacgccttacagcctctgtgagctgtcccccctcatcatagcctacatatccaggaggcgctccgatgagtcgtgacactgagtacttctccatgtactcactcatatcgagtctgaccatgttgttttcatcatcaaacagacttgccgcaagtgcctttgcaagctctgtcttacctacacctgtaggtccgaggaacataaacgaacctatcggctttgtaggatccttgatgcctgcctttgatcggatgatagcctctgtcacctttgtgactccgtcatcctgtcctattaccctcttgtgcagctcctcatcgaggtgaagtgtcttattacgctcactctccgtaagctttgcaacaggtattcctgtccagcgcgatataatgagtgcaatttcctcatcgcccacattctcacgcacaagcgataagtctctgtccttaagcagtgcctcctctgattccagctccttctgcaaatttggaagcacgccgtactgcagctctgctgccttttccaggtcatagttctgctgcgctgtcttgatttcattctttgtggactcaatcttttcacgaagcttgctgaccttgtcaactgcgcccttctcgttctgccactgagccttttttgcattgaagtcatcacgcagctctgcaagctccttttgtagtgctgcgagcctgtcctgacttaagtggtctgtctctttctttagagctgtctcctctatctcaagctgcataatcttacgattctgctcatcaagctctgccggcattgaatcaagctccgtctttatcatggcgcatgcctcatccacaaggtctattgccttatcaggcaaaaatctgtctgtgatgtatctgtttgaaagcaccgccgctgtgacaagtgccgagtctgtgattttaacgccgtggaatacctcgtatctgtccttaaggccacgaagtattgagatagtgtcctctactgtcggctcgtctaccataacaggctggaaacgtctctcaagggctgcatccttctcaatgtactcacggtactcatcgagtgtggtggcgcccacgcagtgcagctcacctcttgcaagcattggcttaagaagctgtcctgcatccatggctccgtctgtctttccggctcctactattgtgtgaagctcatcgataaagagaattatctgtccgtcagaggcttttacctcctcaagcactgccttaagtctctcttcaaactcgcccctgtacttagctcctgcaatcagagagcccatatcgagtgcaaacagttttttgtcctttaagccctcaggcacatcgccctttacgatacgctgtgccagtccctcaacgactgccgttttaccaacacccggctcaccgataagtaccgggttatttttagtcttacgcgagagaatacgcactacatttcgtatctcatcatcacggcctataacaggatcaagcttctgctgtcttgcacgctccaccatgtcgtagccgtatttctcaagtgtatcataggtggcctcagggttatcggatgtgaccttctgattgcccctgaccgtagaaagtgctgtgaggaatctgtctcttgtgagaccgtactccttaatcagctccttcattgccttgtttggatacttcagcagacacaggaaaagatgctctaccgaaacatactcatctcccattgcctttgcctcgtcctcagcatggataagaaccttgtttaaatcattgcccacatagacctgtgcactgctgccgcttacctttgtgcgcgctgccagatggcgctttgcattctctgtgaaatgctctacgtttatctccatcttgtcaatcagcttcggtatcagtccgtcctcctgtgaaagtaatgccacaagcaggtgctcctgttctatctcctgattgccataatcatatgcaagcttctcgcagtcattgactgcctctattgatttctgtgtaaatttttgaatgttcatagtctcactcccttctactatgttatccataaatatgattcttatgtgtcatacaggtaatatcaaaattttatctctaaataatcctttaaataattcttcaatatttccttgtgactatgttataacacgcagattagcactcgtcaagtgagagtgctaacaatttttattaaataaatataaacttttgatttacaagcaaaaaagagtgacttacatcactctcttttactcaatcggctgcacaatccccgaaacatttgccagattctgcatcttatcatcagcgtctgccatgatatccgcgcatttcttgagctcctgctgcatctcctccgtgaatatgcggctcttcttgtagcgaagctgatgctctgtgctggcccagaaattcatggcaatggtacgaaactgtatctctatcggaaccttgtccttgtgatccgaaaaatacacatcaaccagcactatcatatgaagactcctgtagccattctccttcggtttttttatgtagtcctttattgtgacaatctcgacatccgcctgattcacaagcatattggccacctgatatacatctgatataaatggacaaatgaccctgacgccggctatatccttaatctcacgcttcatggcgttggtggtgagcggaatgccctttcgcttcattttgtctattatactgtcaagcgactttacacggctctttatgttctcgattggatttctttcgtgattgtttttgaattcattatttaatatctgcagctttgctactatctgctgtatacccgattcgtagtagaacatgatgtgttcatactgcgaggcaattgaactgaattcgcccagcatcggcagcatctctatttgtgtatcatccatgtttaccccccttacatataatatatttccgcttcccactttataatctatgcatgccggcatagcatgcagtatattcctctgtaaaattatgaagtcagtcacgagcacacatagaattagatggtttttattttatcatttctttcaactactatttttatggaacctcgtgacagttcataattttccttcggaacacaccgcatactctccggcagaaggtttacgagtgggaagctgcattccaattaattatttacttaatttagtaagtaacagccgtgaaattcggtatgttacttcgatgagaatcactcctgcaactacatcatatatcacatgctgcttcgtagtcaatgtggatatgaatactgctatagcgcaaatacagaaggttgtacgtatccactgcggtacttttttattgccacggatgcctatatagcacagccagcttactaggcagtgtatagatggaaaaagattgtccgctgcatccatactatataaaaagcgcatgagctgtgcccatatgtctgaacccactatttccgggcgggtgttggttgtaggatacacgacataacagataaaacagactgcctttgccagccagtctgccatgagaaaacgataacagtgccttttatccatcgctgcattgtacagatatcctataatccaaaaaatatagcagccaaaataaatgactactgtagggtacacaaccggtatcatatcatcaagcgaggtctctatattgtgatggataaaaccgcctgcaatagcacgcgcgccccagtatacactgaaattgagcactactgtaaaaagcagcggaatacgactgtattttggaagtattctgttaaaaaactgtcctgtttgcgatatgctgtccctggataacacgtacttctttgtctccttttatacactctttaatttccggaagcaggtcaatatgaccttttttaaacaaaagcactattgtggagccaatcagctcaaagtgccccatctctgcgccctttctcatcataacattctcgtggtcattgactatgcctcccacaagcagcgcacctatctcaatctgtgccaccttgccaaaattaactgtatcaagaattgtccacatacgcctgttttgcctatatacaggagcattttccagtgcaataggctgtacactgtgaagcagtcccttcacaaaatgattcctgccctgaaatccatcatctatatagcagtaatgatgataatcgttggcacaaagacgcagtatcacgcagtctcctccaacaaattccttttcaatttttttgtcggtgacaaggtccgtcaccttgtaccatgagcccttgatgtgaaagctgttgttactttttatcctgtatgcactcaggtagccgtcacacggactgataagatgctcagcctgcctgtccacctcaatatcatcacgctttctggagaaaaagtcctgaaagctgttatatttctgacccttaaaatcagacatgtctatattgttattctttatataccggctgataaacggcttagacagcggggagcgtgctactatttctccgagcttaagtgcacctgtatgcagaagcaccttaagtgtcacacgcccaggtgccgtggtgtaaagccagtctacaaacgatttttttgccattaaataagaacctccgcaatgagaatacaaaactcaactgcccctatacctacaagcagcacctctccaaaaagagatggctttttgagctttacagggagcacgtagcaaatgccaatgattaaaagggcaagtgccgcgattgtctgtgtatgtatagctgtgaactctccaatcagatataccgccgggatagcaagcgcacttgatgtgattggaagccccagataatactgtctgcgctctgctgtcgctgcctgcctgttggcctcatccacattaaagtatgccagacggataagcccgcaaagtatgaatacaaatatggcaataaatgcaactgatatctttggtgtcacgcaaaatacccacactgccggaagcacaccgaagcatatgatatcacttaacgaatctatctgtatgccaaatgttcgctcgtccctggtacggtccttctttgtggatgcaatggtgccgtcaaacatatcacagacaccggccagcataaggcagattagtgaacccacatacctatcctttatggcaagcataactccaaggaagcctatccacatgcctatgtatgtaagcactaccgtgtaattataaaagcctatgagccctgtctttttctctgtgtctgtattccctatatccagagtatctgctattgcagaattaatattcatattattcatattgattcccttactttcattcttttgtttttatcagataaaacatgataagttttctcatttacccttaaccggtaatattatatgcccttacctgatatataataacatattcatgacataaactcattaattatttgtttaaacttttcttaatatctcttatttttaacaaaaaaaaggcagaacccgctttctgattctgcccacatactatagcatatcatgaattatatctttaatctcctgcttgtccttttcaagaacaaatgcaagctctgcatttaaattgtgctctgccatcttgccatagcgctcatcgacggctgtagacttcttgcctgcctgtgcacgctgctcatttctgatatgtaaacactttaagagactgatcacactatccggctcacagcttctgactgcctccttatagcgcgtttcgcgctccttctcattgtttaccgcgagcgcctctatctcaggtactctatcgagcaccgccagtgcctcatcctgtgttattaccttacgtatcctcttatcagcattgtcaacaggtatatacactctgtcattctcctcctcaacagggcggagtaaaaaatatgacttgagctgcttgtctcctgacatgtctaactccacgatttcgcttattttgcaaattccatttgtagcatttaatacgtaatcacctatttcgaacatatcacacctctttcgttatacgttatcattttatcactttttcacgaattttgtaagaggaatttttaaaaaatgtcaaatatatcaaaaaagcgtgttttacgtcaataaaacacgctttaaaaaattactcaatcagctgcttcacgcggtcatcgagctggagcatacggatgataagctctattgagcccttgataccgtagctggcactgttgatacagatatcatagttacttgccttgctccactttctgccggtatagaatttgtaggtcttcagatgtctcttatcctcagattctatccatttctttgcctggttcggagtcacattcttgtttatctcaagaaaacgctggactcttctcttctccggtgctgtgataaaaatacttatgtgaggaatatgattgtttgtcagaattgcatctgcaaaacgtcccataacaatgaagtcctcctgctttgccttctccacaaggaacttgcttgtatcaaagaaaagcacatcctctgatgaaagtccgtggtatttcttaaaagcttttatgcgctttttgattcccattcgctcttttttctggaaggtagctgtagcctgggctgcttcctctccatccttctgtctgaacacctcattcatgacagacacatcatagaaattcatacgaagcttgtctgcaagtgcaaatccaatctcatttccaccacatccgcaggaacgtcctatacagataatcagatgatcgcccgtcttgaaacgatccttcaggtttacggtatttaaatccgctatctttggatcgaggatatctccgtcagcaaagcctgtcgggagctccgctatctcctctactatgttgttgtatctgaccatgatatcatgccttgtatcgtgatcaggtattgttcttgccatgttgcttatcagggcaagctcgcttcggattcttgagctgttctgccttgagtgcagatcctccatgatgttacggatacatatatccttctcgccaccaaataccctgccgagggatgagcctaatttcttgtatacttcggcatcaagctcatagatttcgatggcaagagctttaattttctcgtcataaaattccataattcatccctcctataaaaagaatatgatcatatctatgatgaaaacaggtatcagataacgcaatgaccaccatatgtaaccaaagaacgatggcatgttgataccgttttcgtctgataatgacttgaccataaagttcggtgcatttccaatatatgtgttggctcccataaatacagcgccacacgaaattgccataagcatcttgaccggcaccactcccagtgtggttgcgacacctgtagtaaagtgcatggctcccgctgtagtaaggaaaaccagatatgtcggtgtattgtcgaggaagcttgaaagtgctcctgttgcccagaacatctcaaacggctttgtgattccaagacctgaacctgcactctttaataccataagagcaggctgcatggtgatgaagattccgatgaaaagcaccgcaacctcctgaattgctccccatgtgaaatggttctgcacacgaacctccttcggtgttgtcttgaaggaaagcagggctgcaagcagaataatagcaatctcaataattgcaggcacagtgagtgtaacctccctgaatatcggaataccgataacctctcctgaagcgttctggaatgcagaaagcttaggaagcacaccgcttagtataacagctatgacaatcattacaatatataaaaagttgtgggcaccctttatcctgatgaggggctcattttccttcacctcaggcataagtcccttagtgatatccttctggtatgccttcttgtccaaatgataaaatatggaaagaagcagtatcatatttattaaaagaaccggaaacagcctcatgctccagaagaacgatactcctcttgaaaatcccatgagcagtggcggatctccgataggtgtaagacatcctccgatatttgacacaagaaaaatgaaaaataccatgatgtgacgcttgttttttctccatgagttcatctgtataatcggccttacaaaaagcatactggctcctgtagttcctatacagcttgaaaaaaaagttccaacagcaagcatgataacgtttacctttgggttgccgaccagacttccctccagcttaatatttccggctacgcagaacagtccaaagagcaacacgataaaggtcagatagtcacctatcagacactccagtaccgtctctacggcttttggtgctccatagaacagcgcgaacggaatggcaaaaagcagtgaccataagataactgcatgagcttgatgcttctcccaccattcaggcttcacaagcggcataactgctatgcacagcaataagcccgcaaatgggatacacaacattaataatgtgtttgacattcttttcacctctactttgttaaaaaataaactaattcaaatctagttcattttacaccattattttttatttgcaaccgtttataaaaagattttaatttatatatgttttttatgtaatatttacatttttataaacaataatgcattaccagttggtaaaattatctataatatagtctgcatcatgagccatatcatcctttggtgaaatattcgatttcacataaaatgcatccatcctgcattcctttgcacccttgatatcggtagtcgaatcatttcctataaaaagcgattttgatacgtcaatatcatgcttatttatcagctccttataaaatctgatatcaggctttttggtattataatcggatgagataaatacgtcatcaaacaaatcaaagatatcaagtcttctcatctcataggctgtaaatatacgctgcgcatttgaaagcagatatacattctttcccgccttcttaagttccttaagcatctcctttgtgcccggataaagctttatgtattcggtgctcatcaccctgaaaaactgacctgtatgcactgaaagctcctttgtcggattcacgcccttttcctcataaagcttttcaaatacagcctctatatgtatctccggtgatgcttcatgggcatatgagatggcaaactgcgcatctgcatcagacttttcaattttcttcttcagctctgcctcgctgctctttacaagtgtctcatagcgctccttaagctcctttgcctcatacagtgctccgtaatagccatagaacatggcgagcttttcccagattgcagtgtcgctctcgtctgtgtgaatatccacgagcgtaccgtagaggtcaaatatatagttatcatatgtgagtggaagtttcatgcttttttcctttcgacaatccaattatattccttaccacccattgtaatatgctttgtggcttgagtgcaagtacttttcttttttcaatagtttccagtaatttcaataatacgtggcataagccggtggttggggcaggcggtactgtcgtgctggctacgcttcgctgttaagtgtctgtacgaattatgcccgcaggttttctatgcccgacgaaaccgtcgaaactcgccatccatggctcgatttctccttgcctcggcgtccatgcctcggcatttctgtgctttacagcataattctacagacactaaacagctgcgctattcgcccacccgacagtaccgcctgcccacaccaccggcttacgccacttacgctgagatataatgtgctggtcctcacctgcggttcggacggcacggcgctctcagcctgcatgtgggaagctcccatcctacgatgcttcccacttgacacactttattcgccggatggcatgcagtgtgttctgaagaaaattatgaactgccacgaggttccatattccctaataacacaaaaagccccagcatatccacaatctatcagcacatgggctcggggctgacttcataattttctgaagaatatactacatgccaccccggcatcctctcagcctgcacgtgggaagctcaaaacctccactgcttcccactcacatcatcgccctgcgaagcttcgccaatgtattcttctccattcgtgatatggccacctggttgcgtccaagcacttctgccacctgcttctgtgtcttatcctgcatatagcggagcataatcagtctgcgctcgctatcatccagtgagttaaacgcctgctgcattgcgatgtgatttatcactttatctgtctccgatagattgtctgatgcttctgcactcattttattgtccaaataatcaagcacactttcattttctattgacgatgcatttttatcagcttccatggcaattattatatcctgttttgacataccggaaatattttccattttttcaagtgatatttcactattttcactcattctgtatttttctctgataattgcaatttttcttgcatcatccagtatttttcgactgatatgtaccattccgtcatcacgtaaaaagcgctgtatttcccctattatcaatggtactgcgtatgtagaaaaggcaaagcccttactttcatcaaatcgctgcgctgcctttgtcagcccaactgctcctatctgaaataaatcctcccggtcaacgcctctgtttctaaagcgtttcataactaaataaatcaggtttatattttctgtgacaagtctgctgattttgtcactcttcatagtatttttttcatctttactgttgttccgtgtcccggttctgatgtaactgtgagcgcgtccataaatgcttccatgaatgaaaaacccatgcctgatctgtcaagctgtggtttggatgtgtataacggttccattgcttttgccacatcctgtatgcctactccgctatctgatatttctatgtaaagctccctgcctatgtagctgcaattcatatgtacctgtggacaacttttttcttctgctgcctggtgatctgcctgagcggatgaaatattgtcatctcccatctcatagccatggataattgcgtttgtcaccgcctctgacactgctgtctttacgtcctccacgtcatctagtgtggggtttaattgtgccataaacatggctgctgtcattctcgcaaatgcctcattctctgaaattgcatcaaagctaagcgatatatgatttgtttttgctgcgttcattatgctccctttctgtctgattatattttaattaattcagttttaaagcctatgtacaatagtgtaaatgccggcacatttcaaaagcttgtccactctgtccgacatattgcaaactgacaccgagctgtcattaaagtacttaagcttctttgttcttcctattatcactccaatgccggagctgtccataaattctgtctgtttcatatcaaatactatttttctgacaccacagccctctataagtgcatcaagctctgcgattatctgcccggcgcagtggtgatccacctcctttggcataaggtatgtcacccggtctgcttccttgatataattttctatcatgtcaaactcttcctttcctgctcatataaaaaagacaccggagattatctggtgtctttcgtaattctatatttaattattgtctcgcagcagttgttttactactgttcctgtgccagataattctttgatgttctggccttctcagtgcctgcgtagttgtctaccacatactgataatatggctttgcagatgctaaatcacctgacttcctgaacgactgcgccagataatatgcaactgaaccatccctgtatgcctcatccatgccgacaagcttctggaatgtagggattgcactctgataatcgccactgctgtatgatgagtatgcctgactgtacagtgcttccttatatgaatctgcaattgaaccattgagcgtatcatatgtctgcttagccgagtcactcaggtagcttgtgttgatattttcaagtgcttctcctgcctttattacatcattggttgtatagtatacataggcattgagcaaggcctcatatgtggaaatctggtctgatactccatcatttttcttcttctcgtcatcaagctccttctttagcttgtctatctgatcattaagtccactgatggtctgcccatttgtggaaatcgtatcattggccgataataactgcttctttgcatctgttttcgactggctttttatgcccggaaccacaaggaagcacgtaaccgccactccgactaccagaccgattataatatagagtatatttgcccacattgagctctccctgaatcgctttggcataatgattgtttcatttccactctggtaggaaattaaatcatcatttttctttttcctctcagttcctttttccttgagacgtctgttcacttcttttaagtatctgagggtagtggtattgtctgtatctatcttgcccgcatcgcgtaaggctttctttgccttatccagatgcccctcctccagatataaaagagccaaaagctgatgtccctttacaagctttggatttaaggataatacctttcgaagctgtataaccgcaaggtccttactgtcctgcttgcaataagttaaagcctgattatattttttaatagtctgattgattgtttcgagctgatttctgttattatgaatctgatctatatacttctttgccagattatcatcaggctgatagtttgcactgatgacccactcacttaaggcgtcaaccatctcacccatctcatagtatatgagacctaacagattccttgcctggatattgtacttataaaacttaagactctgcctgagagagataatcgctccggacagatttctcacctgtgccttttgtaaaccatcattgtagtatgagttggatattctaatagctcttttaaaaagtgaaagatcagccccacatacagggcatttatcgttccagcctgcatcttgtccgcatttataacaaatcatcttaattcaccctgccttttgtcctgctcacgtaataactgtgcaatgatatctgtgacatctgtcagatcgtggctgtaaatcgcagattcagcctcctctatctctagacttggctcatagttctttatttcttcatcaaaatttatcataatcctgcctccataattacctgctaaataatcccatcaaaaaagggtcactatatattataataaagtaacccctttatgcaagtatatttccattaagatttaataaaaatatcgcaatttttttatttcatcgacaacatcacgactgccttatccttctccttgaactcaatcttgtcgaattcctccttggtgacgagctttgagttgttaatacacacctcgacatttggatatacatgctccaaaacctgtactgtcgcgcctgtcgagcgctccactatgcccttaagccgctccagctcctccttatcttcggtaagctctgctgttttctcaatttttgccctgacaagcgcaagcttcttttcctcaagattcataccgtcagcggcactgcccatcatctgttctatctgctttatgccggcttttatattgtcgagaagcatctgcttttgagtgacaagcttttcaagctctgctatctttatcttaatctttttatgcacgcccacatgcacctcagtcttgataaaggcatcattacccaggttttgcacctcaatgcctgcacagccatatacttttccaccgactatgcttgcatgtccaccattgaagattaccttatcattgctgaccacattgcagttgattgcagaatcagcctccacaaagccatctacctccacatcggtatactccatgaacttggcaaacagattgccctttacaataatccgggcctttcccataccaatcatgcccttcctaagaatcaggtcattgccggcctcaagcacacagccctcgcaaacaccatctatcgtgatggactttgcagcccttattctggctccggtcttcacactgccatgtatgaccacgtccccgacaaaatctatatttcctgttcccacatccacatcaccgtttatttcaagaataggaagaataatgattctgttcttgtgcctttcaattttgccatcgatagcagctgtatatgtaagtccatcgacagatttgtcaaagccgcgccccacaagcggtggcagtcccttgcctttctttgcggcaattaccctgccaagcacatcaatgccatcctcgcctgcaacaggctcacaatagtttgcaatcgtctggcctttttttaccacctcaaccgagtgcacactccagtaatccactgagccatcgctcttaaccgttgggcggtggttcaagtcactgtcgaagtaaaaatcaaagtatccatcagccccgtcaacagccggctttccctttgcaaaaagcacttccctgcccataagtcttttttctacaatatctgaaatggtctcgcaattgatgccgtatatcacaccattgcggtttacagcttcaagcacctcatccactgtatagtggtattcttcttcaacagtgggcagcatgataaatgcctccatcctgtcgttgcttattctgataactggctctctctttataccggtatcatccatattttttcctcactatatatcggcctttttgttcctgctaaagtataactatcctgctatttctttaataaatgcatttatgtattattctcactttcactcattatatcatcatttaaattttaagaaaagccactaaatataaaaaatccgggcaatatcattcattgatactatgcccggatttttctgcaatctgaatcttttacggaatttgagtaaattccgacacttattttatgcagttctatctttatgagatttcatcaacatcataatacttaaaatcccggaagcaggcacttcctcctgtttcctctgccgcatagcagaacagaccaaaccggcaaccagtaaaatgatccagtttgaagtacagcttatgcacggttccgatgggtagccagtctcccttatttacccggtaatagcagcgtgcttcatccttcatgttacagaaatctgcttcaagacgaaaatccatctggtgtgattcaacaacagttccttccgtcatatccaatataccatcttcttttttatccagcataaggacttcatattttccatgatgttttgtaatgccaactgcagcataacagccctgcaacgcacacaaacctgcgacatcgccctctttcaatgcagaagcatcaacagtaacctcagctgcgcaggacggataactcatcctttgcgtaagcgtatttactgcctgtgtaagctctgtacaaacttcccgtgttgtaattgtataggttccctgcgatgcatccagatgataataccgtggatctggatcatgattaaactgccagcgcgtaagcagcccattacagaaatcatcacttcccactaatggctgataaatatatcctggtctggtactgtgaacctctatttcttccggcacatgtccgttctgtccaaaaaccggaaaatgatccttccaggtaaccggaagcagaataggaatccgtccaactgctccggaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaaccagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatataaaatcggccttcatgatagcgcagggaagctgcccacatgccctgtccgtaaatattctgaccgcttttcagttgctgcgcatccgtatgatcaaacgtctcatagacataagtcacatgctcccagtgcaccagatcaaaagactgcagaatctcacagcccggcataaagtgcatggttgtggataccatataataggtgtcttctacgcggatcacgtccggatccggataatccaatcttgttataggatttacattcattgtttattcctttctattttatctccatattctttctttgttctattctattcaagaaccaccgcattgtggacggcctcctttgcatccttgccacaggaaaacagtgttcacaaaatataatctgtatttaattatttaaactgagccagacgttcctctacctgagccatcatctgctcatactttgcaagcttgtccttttcctcctgaaccttttcaggctttgcattgtttaagaatttctcatttgagagcatgccccttgagcgcgcaagctcctttgtaagcttatccttttctttattgagtctttccttttccttctcgaaatcaacaaggtcctcaagcggcaggtatgcaaccgcatcaggtatcactactgatacagcgtcatctccaataccggccttgccctgctgtactgtaatctcgctggtaaatgcaagatttacatatacctccttgttgtcctcgaatacctttctgactgcctcatcatcacttgtgatgaaaagctttgcctttcttgaaggtggaacatccatctgtgtacggacatttctgataccctttacgagatccttgcagtgctcgattgcggcttcctctgcctggaaattccactcttccttgtactcaggccatttagagagcatgatagtctcctcgtctgactgaagtgtgcagaagatttcctctgtgataaacggcatatatggatgaaggagcttcagtgcatttacaagtactgtcttaagtgtccagagtgctgcatttgctgactctgggttttcatccttcttgtaggtacgaacctttgcaatctcgatataccagtcacagaactcgtcccagatgaagtcgtataccttttgtactgcaattccaagctcgaacttgtccatgttttctgtggcatcctttgcaagtgtatttacccttgaaagaatccacttgtctgctgcatgaagctcatcaagctttggttctctaagctctacaccttcaaggttcatcatgataaatcttgatgcattccataccttgttggcgaagtttcttgaagcctcaactctctcccagtagaaacgcatatcatttcccggtgcatttcctgtgataagtgtcagacgaagcgcatctgcaccatacttgtcaataacctcaagaggatcaattccgtttccgagtgatttactcatcttgcggccctgtgaatctcttacgagtccgtggaaaagcactgtgtggaatggtgccttgcccatctgctcatagcctgagaaaatcattctgattacccagaagaaaatgatatcgtagcctgttacgagcacatcgtttggatagaaatagtcaagatcctctgtcttttcaggccagccgagtgttgagaatggccagagcgctgatgagaaccatgtatcaagtgtatcaggatcctgtgtccagtgctccttgccacacttaggacatttgccaggcttttctattgaaactaccatctctccacagtcatcacagtaccatgcaggtattctgtgtccccaccagagctgacggctgatgcaccagtcgcggatattgtctgtccagttgaagtatgtcttgtccattcttgaaggaagaagcttgatttctccgttctttactccctcaactgcaggcttgatcatctcgtccatcttgacgaaccactgctgcttgatcattggctcaactgttgtgtgacagcggtcatgcacacctacattgtgtgagtgtggtacaacctttactaaaaggccctgctccttaaggtcctcaaccagtgcctttctgcactcatatctgtccattccggcatattttccggccttttcattcattgtggcatcatcattgattacaacgatttcctctaagctgtggcgttttcctacctcgaaatcgttagggtcgtgtgcaggtgtaatctttacacagcctgttccaaactctttatctacgtatgaatctgcgattaccggaatctccctgtctgtgcatggaagcttcaatgtctttccgatgatatcctgatagcgctcatcatcagggtttacagctacggctgtatctccgaaaagtgtctcaggacgtgttgttgctatctctacgaatctgccttcctcgccaactacaggatagttgatgtgccagaagaagccgtcctgctcctcatgctctacctctgcatctgaaatagatgtcttacataccggacaccagtttacgattcttgagcccttataaatccagcccttcttataaagctttgtaaatacctcctgtactgcgtgtgagcatccctcatccatggtaaatctctcacgctgccaatctgctgatgatccgagcttacgaagctgctttacgatacgtccgccgtactcttttctccagtcccagcatttctctaggaactcttctcttgtaaggtctgccttgttgattccctgttctttaagtgcctggatgacctttacctctgttgcgatggatgcgtggtctgttcccggctgccagagtgcattgtagccctgcattctcttgtatctgataaggatatcctgcatggtgttgtcaagggcatgtcccatgtgcagctgtcctgtgatgtttggtggtggcatcacgattgtgaatggttttttgctgcggtctacctcagcatggaagtagccattgtcttcccactttttgtaaagacggtcctcgatgtcctttggatcgtaggttttgtttagttctttgctcatgttttcctccttttatatgaatgacgcaaaagctttgggggctttgttgtgtcaggtcgcgcattatgtatggaattatgttcatgattacgctgccaagacactgtaaaaattatgattagggattgcttagaccatgacgcaaccggcttttagcgccgtccatggcgctaacgcctcgcccgcacgtccatgtgcgtgcgttgctgggctgtgtacataattttaacagtctctaggcagctccataaatcacataattccatacataatgcgcggcctgataattcaggctgtgagcttttgctgtttttcttttcatttagctatgggcgaccgattggattgcatgcgcaatcttccggtctgggtacataaaaagaccctcccgatcattgaccggaagggcgaattagcgctgtaccaccttcgtttacatcggagcatatatatgcatataaactcgaatgcctcttgtcctgtaacgtggacgaatcggaagaacttatgtcgcttgcggctttctgggttcttcggctcaaaagctaccttccatgatttctgtcttaagcatctttcagcctgcccaaaatgtatcaccatcttacggaccggatgctctctctgaaagctttcgtcatgtactcctctttcttatgcctttaaatatttgcctgtttctttctacaatattaaagtgcattgggtgatttgtcaatatgatttttcaatcatcataatgacctttacatgaaacaatataaattatctcatctttttcataataaacaattcgattagtgtcatcaatgcgtctgctccacataccactaagattttcctttaatggttccggtttacctataccctcaaacgtacttcgctgaatatccttgataagtccattaattcttttcagtgttttcttatcctgcgtctgccagtataaataatcgctccatgccctatcttcccatagtaacctcattagtcctcctctatcaaatcatgctctgcgaagtgagctttgccatccttaatatcgcgcacgatattttccaaataacggatattgctatcagaataaaacggatctaccgatacctcaaaaggaatacgcttttctctgcctactttttttgcaaaaacggtgaacgctgcactcatagaaagacctaattccgaacacacctgttccatgcttttttttacatctgcatccaatttaaaattaacattaactgactgtgacatatacaacactcctttcttgcttatagtatatgcaacaataaagaaaatatcaataagatttcttcattttttctttattataaatttttactttcaaagaaataagtgctcgctataagtgctgttccgcctatatatgccatcttatctctcaagtgtgaacggctgataagcttgtcagtatagttttcatcatattttgtgcagtactgtataaaaagcttatatatacttgtattttcaaacattgaaccaaacactatcgtgcaatccggagccagaatagtcaacacatttacagcgacacgtgccattcgttctattgctccaacaagtatctcagaaattgtctgatccatccttgttatgtagccgttgccctcattttctacccacgaagtcaagagctctcttgttataagatttttatcaccggctgtttcttcgtatagcaccggggtattttccttggaatatatctcctttatgcggtcacacagggcaaacatggatactcttgtttcaagacagccatgtctgccacatctgcacttaagtccatcaggctctatgatgtagtgtcctatttctgctgcgttgtgctgattgccctcatatagcttattgtccacaactatcgcagagccgacacccgggccccacttaataaaaacaatattgtttccatattttccgacaccgtaaagcatttcggcttccgcaaatgctttgacgttgttttcaagtattaccggacactgaatctgtttttcaagtatttctcttatttttacttgattgttccatatgccataagcgtgtatactgatgccattattcctgtcaactattcccggaacacatattccgattccaagaatatctgacagctgaagttccttttcccaaagctgaagctttatttcctttgccagttcttctaaaaacagctgtggttcaatgtccgtccgggtatgtaccttagcttcaacaagcacatttcccctgatattggtaactgtaatgctcgtgtctacagcctcaatatttacagatactatatacttaaaatcataattgatatccacaagcaccttcttacggcccgctctcttctgctccttcatctcacccttttcaagtatcatgtgagcttccatcatatcattgcacagcatggtcacagccgccggtgtgagtcctatctgattggcaatatccttccttgacattgcgccgtttttctgcagtatcttaagtatctgagatttattattgttttttacactatcaagggaaattccggttttaaccattaattcatgctccttatttatgcttcaacattctttgttgcaactatatccacaccggttgctgcagcatcacttagcagtacatcacctatatgcaccggtgcctctaccgtgatccggttgatacagtccatcacatccattatcttttcctttggaatatcctgtgccgtctttacggataccataggtattgtgccgtttttcacacagactgtgcttgtcacgattcgcgtcggatgtgtcacttcctttgctccgtagtctgctccgcgcttacaggtatttccggttactgtgacattttctccatctattgtcaccttaagggcacagcccagagggcagcctatacatgtcaaatttctttcttccatgatactatgcctcctcaatctttatcgtaattgtgcggggattttccgtttcgatgagctgcttcttcttaagcaccacctgctccatctcacccggtgccattacagggtgcttgcggtgctgtaattgtttatcatccagatataccgcaatataacaattcttatacacagctccaactcgaaatctcaccgttacagtatcatccatctgtgcagtatttatagtgcttgggacagtatatctgactccgcctgtagcagttatcgatatttctttgccatcatcactcttatcaccgccgtttttcacatactctgcggcatggcggcctgctactgttgcttcctctgacacataatccacgaggtcgtgcacatgaagcacatttccacaggcaaatacacccggcacattggtctcaaggctttcgtttacaacaggtccgcttgttacaggattgagctctacacctgctgtttttgaaatctcattttccggaatgagtccgcatgagagtaaaagcgtatcgcactcgtaaaactcctctgttccctcaataggcttgttatgctcgtcaacctgagcgagagtgatgccctccacacgctccctgccctttatatcaaccactgtgtggctgagcttaagcgggatattaaaatcatcaaggcactgcacaatattacgcttcaagcctcctgaatacggcatgagttctgcaaccacctgcaccttggcaccctccaaggtcattcttcttgccatgataagaccgatatctcctgagccaagtattactacctttcgtcccggcatgtatccctctatattcaccagtctctgagctgtacccgccgagaaaattcctgccggtctgtagcctggtatgtttagggcacctcttgctctctctctgcagcccatcgcaagtattactgtctttgcagcgatatggaaaagtccgtctgtacggttcatagccgtgactattttatcgtttgacccattttcggactcatcaccggttgagatatccatgaccatcgtattcagtctgtactctatgccaagctctttgacctctttgataaatctgccggcatattcagggcctgtgagttcctccttaaaggtgtgcaggccaaagccattgtgtatacactggtttaatatgccgccaagctcgcagtctctttccagtataagtattttatctattttatttttcttagcggaagctgctgccgcaagacctgccgggccgcctcctactatcacaatatcgtaaaattccatattgtccccctatgttaatctgatattaacccaatatcaatctttcgttacctgtctctttgaagtaagacagactatccgcgattcttgctcattccaacaactatctttgactttccaccgcttttagtgatgtcaagctgcgaaatgcctctctccctggcgataatctccatagttctcggagaacagaagcctgcctggcacctgcccattccggctctggtgcgtctcttcacaccatcaagcgactttgcgcctaacggtctgtttaccgcatccattatctcgccctccgtaatcatctcacagcggcagattatgttaccatactcaggcttttcttttatcagctctttatactcatcctctgaaagcttctttggatttaaaataccttttcttgtctcgataaagtccgcatttttagaaggcttaaaaagcctctcaactattgctgccactctctcaccgatagccggtgcacttgataagcccggtgactctatacctgcacagtccacaaaaaatggtgcatctttaagctcctcgatgataaactcatgtccgtcctcatgtgcacggtttcctgcaaacgatgtgatgacctgacgcataggaagtgacggcaccgaacgtgtgccggatatcgtaacatgcgctaagcccgctcttgttgtatttgtaccatccttgtcatcatgatcatctgctgtaggtccgattaggatatttccgtgtactgtcggggttacaagcacgcccttgccgtattttcccggaagctggaagattgtcttgtcaacgataccaccggctgccctgtctaatagctcgtactctccgcgccttggtgtgatatggattttgttttcactcaccatgttgtgaaatacatcagcatatacaccggctgcatttacaacgcagcgtgcatgaatttctccattttgagtaatgagaatatagcctgcctgctccttttgtatctccttcacctcggtgttaaataaaaactccacaccatttgccgcagcattctcagcaaatgcaatattcatgccaaacggacatacaatgcctcctgtcgggcagtaaatagctgccaccacctcatcagacagattcggctccatctcatgtgctttctttgaatcaagaatttcaagtcccggcacgccatttgcgattccctgattgtaaagctccttaagccttggcatatcgtcctcgctaaagcacaaaatcagcgagccgtttcttctgaactcaaaatcaagcttcttcgaaagctcatccatcatctcatttccacggagattcatctgtgccataagtgtaccggtcttacaatcaattccggaatggataatagcactgtttgcctttgaggtgccacagcacacgtcctcctccttttccaccacacagatggacaggttatatttcgaaagctctctggcacaggcgcttcccgatactcccgctcctataattactacatcatacatgctattttctcctaccaaatttccatacattatttacttgctgtatcactaagctcatttaaaacaatgcaagcatcagctattattcatccttcgcccagttaaatgcgcaggcgacagcctttttccacattttaagcttcttttctctcaaatcagccgctatctccggctcaaacacacggtcaatagaccagtttctctttatatcatccatgctctcccagtagcccaccgcaagccctgcgaggtacgctgcgcccatggctgttgtctccacgcacacaggcctgttgaccggtgcattgctgatatcagcctgcatctgcatgagcagattattggcactggcaccgccgtctaccttaagtgatgtgagattgatgcccgaatcagccttcattgcctcaagcacatcatttacctgaaatgccattgattccagagttgcccttatgacatgatacttgtttacacctctcgtaagccccacaattgttcctctggcatactggtcccagtacggtgctccaagccctgtaaatgccggcaccacgtagcagccgtttgtgtcttttacctttctcgccatgtactctgaatctgttgaggaatcgataaatttcatttcatcgcgtagccactggatagaggctcctgccacaaatattgatccctccagcgcatataccaccttgccgtctatgccccaggctatagtggtaacaagtccgttctttgaggataccggcatctcacctgtgttcatcagcagaaaacagcctgtaccgtatgtatttttggcttctcctgccctaaagcaagtctggccaaaaagcgcagcctgctggtctcctgccgctcctgcgattggaatcggacccccgaaaaacacaggattcacctcaccatatacacagcttgacggcattggctttggaagcatgctctttggtatatcaagctccttaagtatctcatcatcccactttaaggtattgatattaaacatcatggttcttgaagcattggaataatccgtgacatgcacctgtccctgagtgagcttccatataagccatgtctcgactgttccaaacaaaagctcgcctctttcggctctctccctcgctcccggcacattgtcaaggagccacttgagcttagttgccgaaaaataagcatctatcacaagccctgtcttttttctgaaggtcccggtaagccccttttccttcagtgaatccgcatactctgccgtgcgtctgcactgccatactatcgcgtgataaaccggctcacctgtatttttgtcccatacaattgtagtctctctctggttagtaatgcctatcgcacatatgtcggctgccgtagcctggatattggccattgcctcctttgccacctcaagctgtgtggcccagatttcctctgcatcatgctccacccagcccggctttggaaaaaactgcgtaaattccttctgtgccacactgcacatctcgcccttctcattgaaaagtatacatctgttgctggtcgtgcccgcatctaatgccataatatactttgccatgtaaaaatcctccaactctctatatttccagctttttccttctatcctgctacagctcttcctctaccatgctcttctctctgttgaacgcatcatagatacatggaattactataagcgtaaggatggttccgtatacgagacctcctattattgcgattgccatcggctttatcatatctgagccatctccgatacctatcgccgatgtaaacattgcgagtatggtggtcatcgctgtcatcagtattggacgaagccttgtacggcctgcgtctatgattgcctcatgcttgctcatgccctctctcctggcctgattgatgtaatcaatgagcacgattccattatttacaatgaggcctgccagcatgataaagccaagcattgatatgattccgagctcatttcccgtgatgaaaagagctataaagcctcctgtaaacgcaagaggtatacagaacatgataataaacggtgaaagcaatgactggaactgcgccaccatgataagatagataaatatcactgcaagcacaagcataagtccaagctgactcattgactcatttattgtctcatcctcgccctccatgtctattgaatagccatcaggaatgctaagtttatcaatttttgatttaattttattgcttagtaatgttacattatggttttcatcaaccgcacctgatactgtaatatatcttgtctgagcatctcgatgaatggtactcagtgtctgttcctgcgaaatagtgcagatatcactgagcggaatctccttttcactgccatcattatccttataggtaaatgtaaggtttttgatgtcgtccacagtcacatcagactgctctgcagattgtaagtatacctcatagtcctttatgtcggtcgtaatggttgttgcgctcttttgagatgatatctcaccggatacgagctggtatacctgagccaccgtatagccatactttgctgctttttccttatccacagttatcttaagctcattggttgtatcgccaagaccgtcatctatatctgtcacgccctttgtatccttaaggatatctgccacatcacctgcaagcttctgcagcttgtctatatcattacccttaatcctgacagagagaccacttccgaaaaactctgatgaatccatagcttgtgaagatgctgttaccttgcagtccagattctttgtgcgtttttcaatttcatctattaccttatccgatgaaacatccgacttctcatcaagcaatatatacatgctcacgctgtcgcttcctgagctcatcaggttcatggtcgagctgccgcctgctgtagctcctattgtgtctatgccctttatatcagatattttgtccatgaccttatcagacagctctgtaagctgcttgaagtcaagcttttcgtcatcctttgcctctatggtaagtgaaatctgatttgactccatgtccatatccataaatgtcattccccttgacatgcaaagtgcgccactgccgactaaaagcactactgccgcaataaataccaccggcttaaatctaagacatatgccgagcacatttccataccagtccttaaaacggtcaaaccatggatgctttatatccttcgtctttttgagcatgcctgaagcaattgccggtacaaatgtaagtgccactacaagagatgccataagagtaaatgccacagtaagtgccaggtctacaaagagctgtctcgtgattccatcagtaaaaatgattggcgcgtacacacttaccgtggtaagtgtagatgcaaaaatggctcctgccacctgatttgcaccctcaacagccgccttctttaccgaatatccctctccccttaatctgtagatattctcgattactacgattgaattatccaccagcattcctattccaagcacaagtcccgacatagaaatgatatttaaggtgatatccgtaaaatacataagcaccactgccacaataaccgatagcggtatagatgctgcgataacaagcgttggctttatatcctttaagaacaaaagcaatacgaaaatagcaagtattgctcccactatcatattttccataacactctttactaccatgtcgatgtatacgccctgattcatgagcactgtggtgtgtaatccgtcattttccttttccagcgaatcaagcttgtccaaaagacggtctgtgacgtctcctgtagagtagccggtctgcttctccatggagagcattattccgggattaccgttgactatcgcatatgtctcatccgaattgtcagtcatctcaacatctgccacatcaccgacatgaataggagctattccatcaagcttcatatccataagcactagatttgttaaatcatcaattgattttatctcatctcccacctgtactatgtactgcgtgccatttgaatcatttacatagcctgcaggcatatcaaagttctgtgcgacgagcagctgcgagagtgagtcaattgttaaaactgcatttaagtttgacttgtcaagtgcatcatccttactcttttcaagctccttttttgagctgtcaagagatgccgctgctgttgcaagctgtgccgactgctgtcctatgcttatcgagctgatggctgcctgactgtttagattatcataggcatctaaaagtgctgtctctccttgtgctatctggtcaagcccgctttggcactgctctatgcctgtattcacctgaatgagagtctgtgctatcgctgacgctgccgcaggcagatcatctgctgtgtttacggtgattccaagcgccgagagacctgaaaactgtgttgcaatctgcttattaacctgctcaagctgcgctttgagtgctgtgcccgcttcacccggtgcatttgcgccctctttgagtgacggaattgtctttgtatatgtatcactattcatgaagtctgaaagagctgactgaattgtttcaagctggctcttctgctcatttaagcttgcaagagtactctccagctgagttttctgctctgcaagctttgccttttgctcctttagcgtatccactcccgcgctcatctgatccgatgcagatgtgattgcgttttgtccgctctctatctttgcgcttgcatcatccatctgactttttgcatcgtcaaatttctttgaaacggcattatttattttctcattgagcgcatctatcttggcctgattcatcgtgacctgtatctgctcggtgagctcacctgttgcagtcactgatgcgactccctctgtactctcaattgcaggcttaagtgtgttttccacaaagtcggtgatttccgacttgcttttcccatccatatccacagcagtcatcatgattggaagcatgtccggatttatcttcataatggtcggagtacccactccatccttccagccagccttgacctgatctattttctgctgcatctctatcactacagaatccatgttggcattctgctcatactcgcatgtcaccagagaatagctgttatatgacattgagcttacgtttttgatattggacgtagttgccatagctgcttcaagcggcgcggtgacatcgctctccacctcctgtggacttgctcccatatctgttgtcacgataagtgcatactgaaagctcatatccggtagcagatctgtcgtcatcctgccaagtgatacaacaccgagtactattaccaacagcactcctacaagtacagtaaaaggcttttttacactatatcttgatatcatctgacccctccttcttcttttccttgataatgtcctgccttaatttgatagacaatgtgattactgcgattttcacaataaatttaattcgctgttatacttttattatacaatgtgtcggattgcaactcaattggtttatacttttttaagagattttgacaataaaaagacacccaattatacgattaatataattcgatgtccttaaatgtcttttaatctcttttaagattttttatttatttcagcttcaaatgccctcttcctcaatctcatcctcatcatcattgatacctgcaacagcacttgtaacggctccgattacagcgacaagcgcaaagatgataactaaaaaaataactataaagaatgctactaaaaaacctgtatctgtcatataatttacccccatagctgtctcacagcttctttaaaatatagctttagtttaacacacttgtctgtaaataacaatatcgtaaagggctaaattattgactaaatattgactaaaatattgatttatgaaattgctcagtccttgatctgcataccgtttgcatccatatgatagccttcagtcatgatcagctttgataccggaactatctcatagcccatgtcctgaagcttcgtgagcatctcatcgagtgcctgcgaggtgtatttcgcgcctagatggcagagtattatcgagccacaatccaggcttttgtgattgcacactgtatctatgatgttttgcacaccatagtttttccagtcgagcgaatccacatcccactggattggataatagtcacagccataaactgtgtcaatcagttcattgttgtacgagccgtatggcggtctgaataccttcatatcctttccggtcagctccttgacctttttgtgcacatccattatctccgtcttcatctcgcctgccgtgattgttgccatatcatagtggtgctcactgtgatttccgggctcatgccctttttcaaccagcgtctttacacattcaggattatcactcacaaaccctcctgtcataaaaaatgtagcctttacgttgtgcttgtcaagtgtctccatcatactgtcaaaatcctctgctccccaggcacagtcaaatgaaagggctatctttttttccgttgtctgaaccgaatatacaggcagctttctgtctccgaactgactcacagcactgctaagtgtctccatcacctctatatttttcagctgtgatatgtcatactctctgccatataaagcgcctgtaataagaagcgccgacagcagcactccaaaaaggaatctgtgtcggcgtttctttcgttttgtcccattatgtagttttgtattttgcatgtatgctctgtattcactcatgctatatactattctttattatcacaaattatgaataatgaaataactctatttcagttcttctgcccttccgataaactcaagcactacctcaatcgactgatgcgcagccttctccgcaaaggtctggtagtctgtctcgccgccatcgccgtctgatattgagcgaagaatggcaaatggcaccttgttcacatagcacacatgaccgatgctgccaccctccatctctgctgcgattgcatcaaaggtattcgaaatataatccttctgctcctttgtggcaataaactgatctcctgttgcgatattgccctttttgtagtggatattcctgtcagctaagcatgagcacatgagctccaccatttttgtatcagccggaagcagaatcatattgatgcctgagagaagtcccttcggatctccgattggcgatgtatccatatcgtgctgcagcacgtttgtggctactgccacgtcaagcacgtttaagtcctttgtcaaagtaccagccactccgatattgacaatcatgtcgacatcatatttcaaaatcatggcctctgcacatattgccgcaaatacctttcctattccgcattttgccgcaacaacatactgatcaccgattttgccctcaacaaactccactccgctgtaaacctctgtctgtgtgtctgtcatctgagcctttaagtcatcgacctccatctgcattgcaccaattacacctattgtcattttatttctccattcctgctatcttgctattatatttttagtcctcgtttactgtggataagtaaactccatatttgtctggctctcaagcaccttaagatatgcacggcactccttctttgcctcgtcaagtgacagattctcgtaatgtccgcactctatggctgatgcaccaaataccggtccatcatactcaagtatctgctttaagacctctttggtgatttcaaaaacctttcccggctcgacatccctcactacgaggtagaagcctgtctgacagcccatcggtccaaaatataccacatcatctgcaatctcagagtttctcacacatgttgcaaacatatgctccactgagtgcatagctgaattggacatataatctcctgcattaggttttcttgtacgaaggtcatatgtaacgatttctccgtcttttcttgaaatataaaatccaggtttaagaatattatgattaattgtaaagcttttaattctttccataaaaatgtttctccttacttagttgctgtctcaaactgcttcagataatcctcaaatacattgagtgcatcatccacaggctttggtgtgctcatatcaacaccggcactctttagcagctcgattggattcttcgagcatccaccgcacaggaaatttcctatatacttatccacagcaggctttccctcctcaagtatcttttttgaaaaagcaactgctgccgaatagcctgtcgagtactgatatacatagtacggtgtgtaaaaatgcggtatgcgcatccactcatatgatatctcatcatccacgcgcatatccggtccgtagtactgcacattcagctcatgccatagctcatttagcacatccttggtaaccggctcgcccttttgcattttccggtgagctatatgctcaaactcagcaaactgcgcctgcctgaaaagtgtcgtcctgaagccgtccagaaaatgtgtcatgagatattttctctcattctcatcctcacaatgctcaagcatatagtgcattagaagcgactcattgcaggtggatgcaacctctgccacaaaaatcaggtatcctgcgtatgtgatgctctgatgctcatttgaatagtatgtatgcatcgcatgtcccatctcatgagccagcgtaaacacactgtcaagattgtcggcatagttcaaaagcacatacggatgagtaccgtaagcgccccatgaatacgcaccgcttctcttgttctcattctcatatacatctatccagccactctccatgccagccttaagtgtgctgacatactcatcgcccataggctcaagcgcctttgccacaagctttttcgcctcatcataggtgtaggtggtctgtacattgtccacaatcggtgcaaacaaatcatacatatgcagatgctccacacctaaaagcttcttcctaagcgccatgtacctgtgcagagccggcagatgtgcatgaaccgtctcaatcagattgtcatatacgctctcaggaatatcgccatcggataaatacatggctcttgcgctgtcatattttcttacccttgcataaaaagtgtcatttttcagcttgctgatgtacatcatggaaacagtattgctccacttcttgtacgaatcatacactccgcggaacacctgcttgcgcaggcttctgtccttgctgcttaaaaaatctatgaaattgccatgcgtgatacggattttatttccctcgacatcagtgatatatgggaatttgatatccgcgttgttgaacatgctgaatatattctccggtgctgcagccatctcaccgcactgcgccaggatattctcctctgcagccgataaagtatgcgctttctgacgcattatctcatcaatcgcacgcttatagtgcataagctcattgctctcactataaaagctctcaagccttttatcatctatctgcaaaatctccggactcgcaaatgccagcgcacctgatgcctgaacagtcagtgtctcagcctttgacacatatgcctgatatttcgacacagcagtgtcctgatgcgagcgctcattcgcatagacaactatacgctccaaataataagacagctcatcctgcttcttaaaaaaatcaagcagcgttgctgcactgtcggccagatgtcccttaaatccagatagcttttctgcaagctgtgacgctttttcacactcagcctcccacagctcatctgtctcatacatatcctcaagcttccatttgtactcgtctgagatttcatctctcttttgaagccttttctcactcattttgtgttaccttctatcttacttttcttgttctcgtgggttttataaaactacccacacatctgctctgcaaaatgcatatagacgtgtgggatatgtgtgaattataaaaattaagctctactttgtaattaaagtgcccataccacctgaaactgtcttgccctctttattgagctttgtgataagcaccgaacggatggcagagtcaccgataaagtcgatagccgcctcaatctttggagccatggtaccctcatcaaactcgcctgctgcaaggtacttctttgcctcatcaacagtcatggtatcaagtggcttctcatcctccttgccataattcaggcagaccttgtcaacgcttgtaagtataacaagtctgtcagcatcaagagtatctgcaagctttcctgctgcaagatccttctcgataacagcactggcgccctgaagcttattatcctgtgctaaaacaggaattccgccgccaccgcatgcgataacaacctgatccgcatcaacaagagccctgatagcatccttttccactatatcaacaggctttggagctgccacaactcttctgtagcctccctcaacctgtgtcacatggttgcccttcttctcctcttcctcagcctcagcctctgtcataacacggccgatgatctttgtcggatgataaaaagcctcatcatatgggtcaacaaccacctgtgtaagtattgtagaaacagtcttgtaaattcctctgccaagaagctctgtacggatagcattctgtaaatcatatcctatatagccctggctcattgcagagcagactgctgtaggtgtagctgtatactcaggataaatcctgcaaaactcagacatagcggtgtgaatcatgcccacctgcggtccgttgctgtgtgtgataacaacctcataatcgtccctgataaaatctgcaactgcctttgctgtatgctttgtagcctcgtgctgctccggaagagttgttccaagagcatcatgtccgagtgcaataactatttttttcttcttcatgccgacctcctatgcaaaatgaaaactaatttgcttctattatctaatattttgtggaatttgtctagtacttagaacatgaaggatacaacattttatcattttttgtcagtcaacacctcatctaaggctttttgtgctgttttttgtgcttcatccaaagcttcctttgcaggcacaccatctatttctaccttatcagctgcaattttcaatgcatcctttacaacgccatttgttggatcatatggataaattgaaccatgttctgcctgagtatatggtacaagtgcttgagggttttcattagtatacttcatataatcatcatcatttaacactcctttatttaccggtacataaccggtcgacatggaccatttcacttgattttcaacattggtaaaatacttcataaaatcatatgctcctgcctgtttttcctctgaagactttgcaagtatgcttaatattaatgccctggcaacaggctttgactcagtaccattcttccatgccggctgctcaattgcgcctacaatagagaaatccaaatctgcctgatctcctgatgaaccagtgtagccacctgccttgttttgaataacatcatcaatagtctggtaccagtattcccagccctgtccaccagaatggattgccatagtcttatcatcatgaatccatttaccaaatccatcccatgcttcaatccattcctctgaatttatagtaactttttttccatcttcactgaaaattgtaccgccatttgatagtgccgcatccatcaaattatctgctccccacataggttcccagccatatatgaattgtccatcatcttttattttagaagctgcacggcttaaatcctgccatgtttttatgctatttggatcaatccctgcattctcaaatgcttttttgttataataaagtacttgggttgttccatatgccggaataccatatattttacctttatcatcctttgcctgttcaaaaaaagttgaaacataatcgtcattattaaaattctcatctttttttattctatcagacaaatcttcaacaagttttttatctgataatcctcgtgctgcatctttctcaatcaaagcaacatccggagcaacatttcctgcaatagcagcctgtaatttttcatatgtttcagaataatctgcctgcgttactgttttcacaaagtatttatcctgagatttgttataatcatcaacaatatcctggacgacctttactgccgtctttccgcctgaataccaaaaatctacttctatctttcctttcatattttcagttccatgtgcctgactattctctgatgtagtattacctgtactacaccccatcaaggaagttgtcaacatcgcaattgtcattaatgtacctaataatctttttttcatttcaaatttgtcctttctatctttgtctttttaaccttttactccggtatctccacctataccatctataaaccatttttgtgcaaaagcaaacataatcaacaatggtattacaatcactgcactcgcagccataacaagtgaccactctgttccgtatgcaccaccttcaataaaaaaactcctcaagccttgtgataccatatatttatcagaatcattagttattaaagacggccacatataattattatacgaagcaataaagctcattaatccaaatgtaataaaagatgatttagtcataggaaatacaaccaagtgcaatattctaaaatgcgaagctccatcaatctgtgctgcttctaccatcgcacttggcacctgcataaatgcctgtcttaataaaaatataccaaaaatactaaccgaacttgagataatcaatccagtatatgtattaagcagctgatgatttgcaagaattatatagcttggaatatatgttgccgcagttggaagcatgtaagtcaccataattattccaaacaaaatgccgcgacctttaaatttcataaacacaattgcatatgcaatcaaagctcctgttataatctgaataaatacaatagctaatgagattaataaactattaacaatatatcttggtatcggagaattaaagataactgttataaagttctcccaatgcagactttgtggtaaaaatttacttgtatccattatttcttcttttgttttaaatgcactgactaccatccataaaaacggaaacgcagtaaaaactccgactataatcaatataatccattttacaattgcatctatccgatctattactgtatatttcttaaccataaacacgctcctaataattcacccatttcttagatccgtaaaactgaatcgttgaaagtaaaaccgtaattataatcatgacaactgcaacagctgttgcctgccccatattatattcctcaaatcctaattgatagtacatatacaatagcgttctagtgcttccactcggtccaccctgtgtcaaaatttgaatctggtcatatgcccgaagcgaattaaccatagtaatgatcatcaaaaagaacgtagttggtgaaatatttggaattgtaatgtatttaaatttatgccatttaccgccaccatcaagtgcacatgcttcatacaatgcttcaggtactttttccaaagcagacaaataaaaaatcattgcatatcctatactcttccagaccgtaactattattacagacagcattgctgtctgcgaactactaatccatttcaaaccgggcaatccaaagaaagataataccaaattcgccaagcctttgtccggttgaaaaatccatgtccacacaattgatatggcaaccgtaggcgtaatccagggtgaaaagaaaacaaattttataattccgctccccggaaatggtttttgtagaaataccgcaagtacaagtcctatcactattgttggcacaagagtacctattgtaaaaataagtgtatttaataaggcctcataaaatcgagtatctttaaataatgaaatataattttttaaaaatacaaaatgatatgtaggtgtcatataatcccaatccgtaaagctaatccacactgatctgcaaatcggatatacccaaaacacaaataacggaataagcgccggaattgtaaacactaagacacttattcttttctttaaatatctttgtttattcatattgataccctttattttgttcgttatatttaaaatagctattttcatgaacataactataatagtatttcgtgtacacattgtcaatatgaaatttatttttttataaaaaaagaatgctcctactaccacgtagcgaagcattctttcacatatatattgcactattttatttatttctgcttgttctttaattcacccatatatttttttgcatctttaagaaaactgattgttatcaaaacaataactatgcctatcggaaatgcagcaactatacttacagactgcaagttactcatagagctctcagcaaataacagagcaattggtaaaagtataagcagtatgcaccacatcagctgaatgagtttgttcggttgctcaccctcccctaatttcctatagctgtaacatgatacagttaaagcaatagaatcaaatgatgtagcataaaaagcaatcattgtcactaaaactattatcattatcaaaggtgcacatggcaatgtcttaagaatagtaactatcaactcatataaatcaccactcttgttgtactgcgcaataaaatctgctgctcctgacatctgttttcccatcgaatagttgcctaagatgataaagctgatgagcgtagagccaacaccaaatccatatcctccaagaattgtctgtctgatagttctgcctcttgatatatttccaataaagaaaggagctgctacacaccataccatccagtaagcccagtaatatatggtccagtcctgaggaaagttggttttacgtaatggatcggtatacgtagataatcctataaaattctgcaccatagtgccaagagatgacaacccggtctcaagaatatatcttgtttcaccgccaaacagcagtacaatggcaagcagtccaaagaagaaatagatacagacttttgccaaaatgcttattcccttaaatccatgtaataatgaatatgtataaactatacatgtaattataaggataatgatattgattgcggttctgctaagcgatatatggaacacatctccaataattgttgccataagaggtgttgcaacactaaatgtggttgctgttcctgctaaaagcgcaaacacagctaacaggtctataatacgtcctgcaaaaccatctgtgtgttttccaagaacaggtctgcatgcttccgaatatttctgacggtttcttttccttacatgaagcataaaaccaaatgcaactgctaaaacaagataaaatgcccatggaataaagctccagtgaaacagaggaaatacaccggcccattcctgtatgcttccaagctccttaatgtggggattggttgcatacataatccactcagaaaatgagtagaacagaatatctgctgccagaccacatgtgaacatcatacatccccatgaaaagaatgagtactttggtttttcatccggctctccaagaacaatatctccatacttcgaaccagctataaatatagatatcaaaaatatgcctaaacctataatcaggtaataaataccaaacgtatctccaaagaaaaatcttacctgactgagtatggcatttgactgctcaggcaatgcaaaaaataaaatacacaatgccacaattatacctaatggcacaagtgtaataatccaatcaatttttttctctttcataatactaatcctccatatatttcttatagctgctatctatctcagcaagctcctgcaaattgtcaatctcaataatatcgcctttttgcatctcatatatgccaagctgatattcatccggatagcagaacattgcaacgtcatcccagtatatctgagtattttttttgttctcaaattccatttcaagatgttttttcagtttgcgcccatctgccgcagtccatctggagatgctataaagctgccatccatgacttccaccattcctgctacaggatgttacaattccatcttctactgtctgaagccactcatctgttttatcatcagtccatacactgttataacccgaacgttcgaattcttttgatagaatttcaggattatatataatctggtcgccatcaagaataattgcatcctcaatatgatctcttgcaacatatagtgatgaaatattattacagctttcataataaggattttcaattatagtaactcccggatattcattctctaattcataaaactgttcctttaaatatccggcaacaatataaatctccgttattccattatcatgtaagccttcaataaccgtatctatcatacgctttccattcacccttaccaatggcttcggagtggtcagcgttaccggtctcatacgattccccagtcctgctgccataataatcgcgcgttttacttcatgcattcttaattatcctccaatttctgcatttcatcctgtactactttgtaataatcctttgcatatctgtactgtctgagtgaatattcaccaaaatcaacgcccagatttctcttgtactcacaccagttactccataaaagtccgcatactgcaatataacaataaatctttattcgggtttcagctgaacacccttctgtgaaatatgcatcaattaacttatccacatgctccctgtcatacattgaatatatgcagaacatggctatatctacgtgcggatcctgcattcctgcatattcccagtcaataagtctgatgtcctcatttccattttcatccttaacaaaaaggaaattatccggaacagcatcaatatgcgtaagaaccttttcatttacatgagcttctatatacggtctgagtgaaaggacattttccttagtctgcctgtaatgtctgtatgcagaaggcgaaccatcccacaggctctcataaaactcaagctgaccgaatatatcaaattcatgatctactttaagcttcatatcatgaaattctctgagacgcttcatacatttacaaacatcatcattattttccggatcacatactctcgcattttctaaaaacgcagtgattttatatccattatccggatttatataagcgatatcatcacatatatgtctgccatcaatagtattataaaccattgcttcattacgtctgtttatcagctgatccgttccctctcccggaattctcatgatatatttttttcctttacatgagaacaggaacgagcggtttgtcatgccctttttcaataccgtaatatctacaatatcgtctgctgatacagataaagcatcgcagataacctgtattgcatcagttttcagatgatttgaatcgctgtccatctctctgagctgctcatatgtgttaatttcaaccacatcccacgaatgcactaccctggcagtaataaacattctgtccttatcatacagtgcagtctcccagaattcaccatcattagccgaattactgcacagtttttcaattctgcctttgacaatttgtgcatcatcgtcaagcagatagctaattcctatcatagcattgccgccggcagccttcggtatggtaaccagttccatttttctgttaacacgcaccgtgctgtcatcatcaatcaaatcactgaccatataccaggaatataattcatggtgatggtacggattcttgtcgcaccatatatcacacggtatgatatatgtatttgataaatgattcaaaaccttctttactgaataaagattattcttagtcgtatactcttcattgacaacgagctccaccccaaaatcatcgataagatactcatacctctccttcataaagccgacaactacatatatttcataaattcccacttcatgaagctgtctgatagtccgctctataagtacttctccatttacctctaatagtccctttggagtctcggtatttataggcaccattcgcattccataaccagctgccagaattactgcattcttcggagccttttctttgaattctttaagtgccttaggtgtaacagcacatttttcatttatataaccttcattcatcaattcttttattgatttgtttacaactcccagagaatgaccggataactctgatatctctctttgattgttaactgattgatgatataacgtgttcagtatatctttctcttgtttgttcatgttcgtctctccttatatttttatgaacactcataatattacacctttttatttagaaaatcaacccctaactatatttttcataacaaaaaacgcgccacactggcgcgtttttgtactcataaatataaatgaattatttactgctgaatatcctttgcagagcttaaggttacttcaaccttgctctcttcgtactgtctgccactctgacgggcaacagtaagagtaaccttatctccggccttgtagctctttaacgctgactgcagctctgtcatagaagaaatctttgtgctgtcaacagcagtgatgatatctccctcctgtaagccggcatttgcggcacctgaaccagctgaaacagatgaaacatacacaccctgtgggaagccgtaggctaccatctcagatgaaacatcgccacccttgataccaaggtatgcctgattctcattagtatattttccgtcctggatgaggctctcaataataggctttgcaaccgacataggaattgcatatccgataccctcaacctcagttgaagaatattttacagagtttataccgatgacctcgccattttcatttaagagtgctccaccactgtttcccgggtttattgctgcatctgtctggataagcttgttattggtaacagtctcacctgtctgtgaatcctgtgtagtaacagttctgttaagcgcacttactatacctgttgtgacagactgtccgtatccaagtgcattaccgatagcaattgcaggacttccaacagctacactttcagaatctccgattgtagcaatcttgatatttgagtaagtatcttttccaagatctgctttctttacacgtacgactgctagatcgtcatccggatctgttcctctgatttctgcctttaccactgaatcatcatcaaactgtactgtgagctcctctgaatctgccacaacatggttgtttgtagcaatgtagagataatcatcatcctcactcacaatgatacctgagccgcagctctgagactgctgtgactgctttccgaaaaagctgttgtaggtgactgttcctgtatttgtgatagcaacgatgctaggcatgacctcatcgacaacagatgatacatctgtcagatcctttgcatcccctgaggatgtctgcttagtcccaccggatgttgtagtggtaagctttgcacttgcagtagaagaatttgaaatagctctcgtgccaatatagcttactcctgtgaaaacgccgcctccgacgagcccgaagataagagctgccgctactgtctttgctgcaaatggtccaaacgcaccaggttttctaggtgctctctgcttcttaggctttgcagcctgctggtatgcctgaccattcatattcatccggctatatgagttgtctgtcgaaccagctgatgcgccaccatatgcattattatttgtgcctgaattatatgcctgattagaataaggctggtttgcatatgactgatttgcatttggctgtcctgctgcagaagcctgcgaatatggattgtagctctgtgaatagctttcagctgatgcattattagtctgtgcagccctctgtgactcatccggattgtaaggattacccgacattgtgaaatttacattgtttgtattgttatttgtgttatttgtactgttagtattatttgtatcattcatatttctataattgttatccataataatttctcctttcgtttacaattagaagtatactgtcaatctgtgtttaatttgtgacgggattatttattttttcataaattgtaatccccgtgctattctccgaataaaaataactgctcatcgacagatgcacctctaagtctgcgataaatagaaattgcagaatatcaatacatccctgctaatgaacagttaccataaatcatatattaaatttcaattccgttcttctcaagaagagctctcgctgtttcaaccgaatctgtacctgtcgcattctttacaggtgcaaactccttctctctgtctacctcaaatggcaggctattgtccatcatgtataccatatcgaggatgagtgtctcgaacttgtatgcattcggagtctcaggcttatgctctgtaccattctcatcaatgtaaggcaccttcttctctaccacatgaagtggaaggctcttctctgcgatagccatgagcttgtccacgcggaataaatagtttaagataacaccaaagccatactgcaatgaaccattctcgttctttgcctctgccatctcaggagtaagctcgtaatactcgacaatcgaaggcttgccattctcaagacacatagcaccaactctctcatatggatcacattttctgaccaccttagagccgctgacacagccggactcgattgtagcacctacaaatacaggatctgcaatctgctgaagcacattgtccacagcaaatacattaagccactcaacacccttgtccttcaaatccttgtcaagaccggcatttattagtgacttgaaccatccaccgtttccgtttggcgacatagcaagtgaatcctcagatttcatgagcagattgccatcaaaatcaactgccggaaccatctcctgcacgaaaaacttcacatagtccttgttgtatccaaaatagtcgtgctcttcaaagaactctcttgtcatgctatcatttatctcgcttgtcataacatacagaggcacccatgtaccggtctgatttgtaaccttcatgaggtttgcgacaagctgctcaaagatgtagagtttctttgtctttccgatattgaacatgcccttagccttgtcaaagccaagacgtgtaccctgtccaccagcaagaagaatcgcaccgaccttgccattcttgaccgcatcaagacctgttgcaaggtatttgtccttatttgccgctatctctgaaagctccatagcagcaagcggtgaaaatgtacctctctgctgctccttgttgtgaatcatatcaaggtatgaccagtccatgtgctcaagctggctctcaagcttagccggagcttcctctgttaagaatttctttaagtatttctggtttgttgccgtgattttttctttgatttctgttttcataaattctcccttgttcttgtaatttagttgttatttaatcattgattttccattaactattcattagttataggttattacattattaatcatattaaattatgtgggaccaatctattgattggtcccggatatattgttcatataaatattgttttataaaacttattgcttataacagctaaataaataccatcaggtaattactcatctgaatcatctgatgatgatttcgttccagaattattttcagactccgactgactgttctttaatgaatcctgcttatccttattctttttctttgccccttcggttccatcagaaccaacagtatcattgtactgtgagagatcaaatgcagaagtctttgacgtaacacctgtttttttagcaatcttgtcactgacactttgaactgtctcagttggctgataatcagtctcattaaacagaaactgatgaagtttggaaacattctgtgctaaatcaattggaataactgtatccccagtagatgaaagattcattgtagtcagctcaaatgggaagcctgttgtctccttcatctgaaactttgtaacataagaagcatactgtaatatctcggtagctgtaaagtttgtacttatctgactcatgatatctttacacatctctgtgagcgagcctaaatctgactgcttagccttgtcaagcatagcctgaagcacaattctctgacgagatgcccttaagaaatcatcaccagaggtgcttctgatacgtgcatagcatgtagcctgagttccatcaagatgctgcataccatccccctcaagataaggagtattatatcctgtagtataatcaacctcaggaatcagataattgatttccttcatctccgccttagtaatctcaagatcaagacctccgatatcatctatagcatctacgagagccttccagtcaacacaaacatacttcgtaatattcaaatccaaatttgaattaagcatagctactgctctctttgccccaccattagcatatgctgcatttgcctttgcaaactttccattgcctataggcagatacgtatctctgtagacagaaacaagctgaacctccttagtatcataattcagactagcgatcatgatacaatcggaatgcccctcattgtatgaaccattacttctgttgtccagaccaaacaacgctacattgagatatccatgcatattggcaagagcatcatcatcaatatcctcattgattccggcctcactagctgtcagcgcatcctcatatttaacctgtccgagtgtcttattataagcccaaaccactaacagaacaattaacagcaacaggatttcaaatacaaaaagtataatcttcttacgtccacttcttctcttttttcttcttctcttctttgccatgttatttttcctttttcctatgaatgtaaagccacgcgtctgcgtagtcctgacgctccttctccgacatattggtatactttccaaactccagattcgtcagacgcatctgcggcctgccacacttgaagcattcaacctctttccttcttgaaaccatccgtatccagccacaatccgggcaaatgtatattttcatcatagtctttattcaaactgtccgagaacatcagctgacaaagcatcaagcttagcctgtgaatcttcaagagacactcctttaactccgaaatagaatttaatcttaggctctgtaccagaagggcgtacacagcaccaagcgttatcgttaagttcgtagtaaagtacattagaagaaggaagacctgtcggctcaacctttcctgttgtcatttcttttcttgtgtcattcttgtaatcacggatagcaagcacctgataatcaccaaatttctttggctcagcggcacgtgcctttgtcataatctcatttatctgtgcagcaccatcaatgccctttaaggtcattgtggaaatgccctctctgtagtagccatacttctcgtacatgtcaatcatgccatcccagagagtcttaccctgtgacttgtagaatgcagctacctcacacaacatacaaactgctgcaggagcatccttgtcccttgcatatgtgcccggcagacatccgtaactctcctccataccgaatacataattgttgcagccggttttttcaaatttgagcatctgctctccgatatacttgaaacctgttaaaacctcgatatgctttacgccatatgctgtcgcaattgccttacccatatctgtagaaacaattgactcaacaaatgcaggattctcaggcagagtaccattggcactcttctggcttaaaatatactcaccgataagcatagctgacatatttcctgtaaatgtcacatactcacctgtctttgtatccttgcagtatacaccgagtctgtcggcatcagggtcagttgctaaaacgatatcagcatccttttcctttgcaagctcaagtgcaagcttccatgcatcaggattctcaggatttggataaggacatgtagggaaattgccatcaggcactgcctggcttggctcaatgtatacattctcaaagcccatatccttaagtactctctgtacagggcgaagacctgtgccgtggagtggtgtgtaaacgatcttgatatcctttgccatagccttgataatctctggatggatagaaagcttgcggagctctccgaaatatccctcctcaacctcatcagagatgacattgtaaagaccagcctcaatagcagcagctttgtccatagtctttacctggtcaaatgatgtaacctttgccacctcagccatgatgcttgtatcatgaggtggagtaacctgtgcaccatcctcccagtataccttgtatccattgtactcacgaggattgtggcttgctgtgataacaacaccggctattgtaccgagtgtccttactgcgtatgacagctcaggaacaggtgcgagctgtgggaatacatatgtcttgattccgttagctgcaagacagagtgctgtggcatctgtgaactcatcatgcatattacgtgagtcatgtgcgattgcaacacctctctttactgcgtcctctccctgtgaaagtatgtaattcgccaatccctgtgtagcctgacggactgtgtatatattcatcctgttggtgccggctcctattacaccacgaagacctgctgtaccaaactcaagtgtgcgatagaatctgtcctctatctccttatcatcacccgcgatagccttaagctctgcctttgtggcctcatcaaaatatgggtctgtacaccatttctcgtactccgctctaaaatccatttatattaacctcctgtgtcagctagtaataagcctattaatgttaactataccgattttaccacattaacgtgcatttgaaaagttttagttccttaatatttttttaaacaccaggctcctcatccaaagtggcatcatacagacaacaaactgtgccgcaaccgtaacaaaataatccgccgcacttatggttcctgtctttaaaatacgctttcttcctgccttgtatttaaggaaataatcaaagccgccacgcctcttcagcatatcatcaccggttctggcatacacaagagtctcacctatatttgccatacgacagtgatttctgatcatattcgcccaaagaagagaatcctccataagcaggcagtcctgataattgcctgcagcaagcaccgcagaccttttgtacatcacagtcatgtgattgaacgcatcgcgctttctctgatactgctttatcacataatttccgagaggcactgtcctctccgataaaatattacgtgtatcatcggaaaactcgctgatgtagccgcctatgatatcaagccccggattttccgaaaaagcattcagctgtctctcaaaccggtcaggcacacatatatcatccgtatccattctggccacaagctcattagagcaatgctttatgccttcagcaagtgcaagaccgagcccgctgtttttttcaagctttaccgtaacaaaacttatttccgaaggcctgcattcataatctctgattgcctcataaagctcctctgtcagccggccatcctccaccagcactatctcatccggtaaaacagtctgcgaatatatgctttccatacactccctgaaatactcaggcttttccttgtaataaattgacagtaagactgaaaatttgactttattcataagtatcatcctcccagacaagtaaactaatgtattaccgcaagcacagtctctatacacagtctgatatcatttatcagcgaaaatctcttaagatacttaagattatacctcatcttgcccggcagcaccttgtggatatatgtgtaatccacatcatctgcagcctccagaagcctgtcctcatccttatacctgatgcttgcctcacttgtgattccggcaggcatcagaagtgtcgccatcatcgcaggtgtatatgccatgacatacttctccacctcaggtcttgtgccaacaaagctcatatcaccacatagcacatttataagctgcggaatctcatcaagcctgtactttctgatgacagcaccgactcttgtgattcttgaatcgccaccgacagtcacgagtgaaccctttttgtcagcatcattcaccatagttctaaacttgaatatgcgaaactttctgccatactgggtgatgcgctcctgtctgaaaaaaacaggtcctctgctatctacctttatccagacagcaaggaccagtataacaggcgaaagcagcacaagaagaacagcggacataatcacatcaaaaatgcgtttaaataccatgcttgtcctctttctgctcagatgcctgtaatatttaagtgtaaaatcatttttcatgaatgtaggaatctctccccatgttctccatctactcatgtaaaatctccaataaattattaattatatactccacatcctcatcgctaagctttgtgttaagaggaagtgtaatctcattctcatactgctgataagcatttggaaaatcagctatatcaaagcccatattcttatatgctgtcatcatcggaagcggcttgaaatgcacatttgtggcgatacctcgctccgccatctgcactataagctcattacgcctatccacgccgatgcccggtatacgaagcagatacagatgtccgctcgatgtatgcctgtctgtaaaatgaggcacagtcaagagaccaagcggcttaaatgcctcgtcatagcgctctataatatcacggcgcctcttgagaagcccctcatatctgtcaagctgtaccagaccaatagcagcctggatatcagtcatattgcacttatacgaaggagccacaatatcatactcccagttgcccagaccattcttgtggagtgcatcctttgtctgtccgtggagtgaaagcagcataaactgcttgtagatatactcgtcatcaaagccctctataggtctccaggtgagtgctcctccctctgctgtggtcagattcttgaccgcatggaatgaaaagcttgtaaaatcagctacattgccacacataatccgctcacctgctctcatgtaagaagcaccaaaagcatgagctgagtcagccgccacaatcacacgtccgattgccctctgcacatcatttgacggatgaaaaagagccttctttctctccacaatatcaaaaatcctgtcatagtcgcaaggcacacctgcaatatcaaccggcacgataacctttgtcttttctgtaatagcagcttccagggcatcgtaatccatctcaaatgaatcaggtgctacgtctataaacttaagcgctgcacctacatgcacagcagggcttgcagatgcagtatatgtgtatgcacttgtgatgacctcatcacctgcacctatccctaagaatctgagtatcgactcaagacacgcagtagcagagccaagagctacagccttatccgtgccgcatagcttagcaatcctcttctcaaactccttggtccttggacctgttgtaatccaaccgcttcgcagtgcatcagcaacagctgacacctctgcctctgttatatcaggtggtgaaaatgaaatctgtctcttttccatagttatgttcctcgcttccggcataaaatatgccaaacatccggcttttacagtctgtattatgagcttcaaaagatatttagttctccaggtcaggatgatatgtctttaccacagaggccactatctgcttgatatcctttgcttctgaggtgcatgccttctcgagcatctcaagctgcttctcaaagagctcatcatccatctcaataggctcacccacatgaatcagcttgttcggagtctccttgagaccctcctcgctcatcagcatctcctcgtagagcttctcgcccggacgcaggcctgtgtatacaatctgaatatccacatccggctccagtcctgaaagcctgataagattcctagccatatcatcaatcttgaccggctcgcccatgtcgagcacgaaaatctcgcctccgtgagcatagagccctgcctgcagcacaagcgccacagcctccggaattgtcataaaatacctgataatacgcttgtccgtcacagtaacaggaccgccatcctctatctgcttcttaaagagcgggataacactaccattgctgccaagcacgtttccaaaacgcacagcgacaaaatcagtctcagtctgcctgttcatcatctgtataaccatctcacacagacgctttgatgcacccatgatattggttggattaaccgccttatccgtagagataagcacgaacttcttcacatggtactctgctgcaatccttgagagctttaatgtgccaagcacattgttctttattgcctcattcgggctttcctccatcagcggtacatgcttatgtgctgccgcatgataaataatctccggatgatatgtctggaatacatagtgcagcctgttagtattgcgcaccgagccaatcagcgtctccacccttacataaggatatttgcgcttcagctcctgctgtatatcgtatgcattattctcgtaaatatcaaaaatgataagaagcttcggatcctccctggctatctgacggcaaagctcactaccgattgagccaccgccacctgtaaccatgaccaccttgccctgtaaaaatgaatgaataccgtcattatccacaacaaccggatctctgcccagcaaatcctcaatgcttaccggacgtagattggaaaccgacactcttccgtccaccatctgatagattcccggaaccacagacacatcacagccggtatccttacaaatattgagtatatccttcctgtccttaccggatgtagaaggtacagcatacacaattttcgtgatatcatacttctcaaccatctccggaatgtcatttctgttgccgacaataggcacgccgtctataaagcgccccagcttcgccggattgtcatctatgatgcagcaggcctttgtgtgcagatgtgagctcatgataagctccctgataagcatcctgcccgcatttccggctcctataatcatgaccttctcatcaccgtttgcagagcctctctgctcaagcatcttctgacctgtcctgaaaaatctgtacgcaaaacgacacgctgtgcacagtgcaaagctgagcatcagtccgataatccagaaggcatacggcatcttaatctcatacacctcatgaatagtaacgctcacaaccgcaagcaccagaaaggcaccaataatatgcataaattcattgatgctcgcaaaacgccatatactgtggtaaagtctgaaaatataaaacaccacaagtgaaatcaccataaacaatggcacaatgtgcagataaccctccaaaaacgagagcggaatatgtgaatatgaaaactcaaacctgatcatcaaagcgaaaaagaatgagattgcaataatacacatatcaacaaaagcaagaaccaatgccctgaaaacccattgcttgtcattgcccatgtatgcgtccggcttctccggaccatcgtattttgttttgtcttttcgattatttgtatcttttttcatgtcaagtctattactcatataggattttctccttctgtcccacactgcaaaaagcagcttctatatccatatgtaaatcaacttctcataaactgcgtttaaatttacgttttattataccatatacacactattatagttcttattattttattaaatataccacatttagcgatttttgaaaacaaacagcttgcttatcacatagttgagcaccaccacaaccacctgcgctgccagcttcacccacatgctaggatagtccagaagcgtgataaaaataaagataatagtctcttcaataacaagcgtgatgaatctgccactgaaaaaagcaaacatctgtactaaaaatgccgtcttggtgggcgttgcagccttaaacacccacttcttgttggtaacatatgaaaaaagaacagcaaacacccatgccagtgcgttcgcaatcagctcattgataccaaagaatacattaaaaatggcatatgagcctatgctgatcacaaaggtcatattgccaaaaaacgtgtataaaacaagctccttaaactcctctttcctgtttcgtattataatattatccatttctccacctatgtgacaggctttagcccctgtcgtaatttatacgtgtaagttgatagtaatgttaatttgcgatttttatataataactgcatagccaaaataagtcaatatgtgatatgatatctgcatgaaaaagaaaacacaaaaaaacaagagtataaaactaaactacatatataatgtgagctaccagatactcacactgattacaccgcttatcacagcgccgtacctctcgagggtgcttaaggcagacggaataggtgcatacagctatacctactcactggtatcatactttatcatgtttgccgcactgggcactgtaaactacggaaacagggaaatatcatacctgcaggaggacagagcgaaacgcacaaaaaccttctgggagatagagcttctatccgtcatcagtgtgattgtgtgtctttgcgcatatatggtattcacacttgcatttgggcactcaccactcaaaaagcacctgctattgattgaagccgtgtacctgatatcagttgcttctgatatctcctggctgtttcagggacttgaggaatttggcaaaatagtcggtcgaaacgtgatttttaaaatcataaacattgcttttatcttcatcgccgtgcgctcagagagtgatttgctcatatatgtggcaggagtatgtctattagagctttttgccaatatatccatctggttttacctgcctcaatatgttgacagaccaaagcttaaggagcttaagccattctctcatctaagggctactctcacactatttgtaccaactatagcgacaaccatatacacagcgcttgacaaaaccatgctcaacaacataaccggcagcatgacagaaaacggctactatgagcaggccaacaagatatccaaaatggtgctcatgctcgtaacatcactcggtactgtgatgcttccaagaataggaagagccttcagtgaaaataaaaaagacgaagtaaaagccctcctttataagagctttcaattcgtctggtttataggtcttgccctgtgctttggcctgataggcatcgcgcgcaatttctcgccatggtttttcgggcctggatatgaaaaggtgccatacctcatcatgataatggctacactgttgccgattataggtttaagcaatgtaatcggtatacagtatctggtaactaccaagcgtgaaggtctgctgacacgctcagtatgtatcggagccgtagccaattttgtcatgaatatgattctcatacctcagctctattcatacggtgcagccatagcatctgtcatctcggaggtaataataactgccgtgcagctttacttcatacgaaatgagctaagtataccaaaaatattttctttatcgtggaaatatcttgtatcagcagtctgtatgcttatcgtactgctgctcatggatgcaaagctgtcagtcagcttcatgcacacaatgattatgattgtgaccggatttataatctatatggtgctgcttttactgatgcgtgacgagatggtatgtgaaggcataaggctcatcaaagccagaatcaaataccactaaataataccattctgcaacgcttaattccccggcagcttcacttatttggctgcctcatactctccaaccacctgtgcctctcctctgtcagtatattctcttgccattttcagagcttttttagtcctcttcacggacttttcccatcttgaaagctctgaacctgtcgtatcagactttatcccatattggtttactaccagattgccaatatatgacgaaagcttttgggctccatatgcattcagatgctcaaaatctgcgaaatcatgtgaatcatctatccctgcaatgctctcataatcagtactcagatcaagaaaatcgtatccatactcgctcgttatactttcaatctgctcaagccctgacttatcagcagcctgtgtctcatgaggtggctgcagcaacagcacatgctctatgccaagcttattgcagtacgaaagcagctccttaagatatgctctgcattcatcagtcagcacataggcttctttagtaggctgtccgatatttgccagattgtcacggcctccggtgatgcctgtttttgaataaaagcccttcagatagcctccaccactgagcctcatataggcacgagtgacaaatgaggtatacactgcctcaggggccttccagttgccatgatacttctccaatggaaaataaagggtatccgatatattatccttcaccttttcatcatcattattgatgtttttgggaatagtctttaccgtgtcaagcttgttctgtgacataggcatattatcaatccactttctcagataaacctcatcagtcagattactattgcaataactaaatgcagaagcattgattaaaagaagcttcggcttctgtctcttcacaatctccgtgacgatggacttgtacatattgcatggcacagctcctattgaaagattgcacgacttaaggccatactcctcccacgccaacgccggtgcatagcccgtgtatacctcacttggtccaatcatgaccatatcaagactgttctttggttctgagtaaaagccatatatattttcgatatcgctgctgtcaatggcaataaatgcctttgatactatttgcatgagcaaaaggaggactattgcaaatgcaggaattttaataaatttcatggtgtttccttttctattgaaacgctttattttgatattttttcagtaaacactatatagtatatcggattagtattaaaaaacaacaccctgatttctatttgtcattttctgacatcgagctgtttacccgggtagaatataaaatcgataagcctgattttctttatgatacactcatacaatatccagcatatagcagtgcttcctgcaaatccacatatacactgcagcgccatattggttataccagccctgttcaatataatcctgattccacctacaaatatcacattcatcgcataaaacggcatgctatcccggccgatagtctgtaaccatttagggaaatcacaataccttgataaaaaatagcttactgcaaatataaatactgtcactatacaggcggtaaaccgctcaaacagactgctgaaaaggggattgctgctcatgtcatcctgtaatactatgccggacgcctctacaagcacactcataacggcaaggctcagcacagcatatctattatccagtttatcaagccacttcttaatcaggcatcccagataaaagtacatctgaaagccggctatgtagttaaagccctcatagtgaaagctgccatagcatgtgaaagcaattattaaaaacagcacaaataaaagctccattttataattaaaatgtggcagaagcctcgcaaacacataatcagccatatacgccacacaatatatgagaaatagcgcgtataaataccataaaaactctatcggcttccacggtatgcttatcaggctgctaacggcaaccggctcccttatcaaatttgaaagggcaaatttaataatccagtaaataactgaaatcatcacgtacggcagcaggatattaaatgctttatgacctatccggctaaaaatgccttgtgaagcatcccctacatattcactgtataagaagcctgaaactgcgataaagcaaggcatgtgaaagctgtatattacatttgcaataccattcattgtatcatcaaatgagtacatgtctgtcagacccaatgtagtgtgacctaaaatcacaaataaaataaggatgccctttatgaaatcaattgttttatctcgtgtggtgttggtttgcatgttatgccctcaaatttataaaaataaatataattcatcatttttattttgtctaatagaaattttaataaatgttccctttaataaacaactacatgtgttccactcggaatgttatcatatatccatttagcgttccctatttcaagccttacacatccatgagacagcggaattccgactctgccatcctgaagtgtaccatttttgttatacaacacactatggaacaaataatttcccttaaactgtgtataataataacatcttgaattgccggaatcaaaatagtatcccttaccgccaacattaaattcgcctccaacagtcggagttgctgcttttccaggtgcacacggccatgcatattgctgagtccaattacctctgcttccgtaataaatgcctacaacacaagcttttctgtccaccattattaaatattttgttgaacttgaatatccctgtgcatacgaattcatgcttgaaaaatcaacccaatctccactcgcattaaaataataccatgtgccattaatagattgccaaccggtctgcataaccccatttccattcatataataccaaaaattagatatatactgccagcctgttgtcatcgctccatttccattcatgagataccagttgccatttatatactgccaacccgttgtcatcactccacttgaagctatataataccactgaccacctatatactgccagcctgtaaccataattccacttggagctatataataccactgaccacctatatactgccagcccgttgtcataataccattgacatccatataataccactgaccatttatgtactgccagcctgttgtcatagccccattagcatccatgtaataccagtagccatttatatattgccagcccatggtcatagccccattagcatccatataataccagtgattatttatgtactgccaacctgttgtcataataccattgacatccatatagtaccaacatccatttatgtactgccaacctgtcttacaattaccttctgtatccacataataccacaaaccactttcaccttgtgtccatatgtaacctgactcttcagcgaaaacactggtattacataagctcagaattgcaatcgttaataaaactattatttttttcttcataaatataacagctcccttcgtctctaattccatacaccatttgcattaaaataataccatcttttattaatataatgtctgccagttaccattattccatctgcattcatataataccaatgtccgcctatatattgccaacctgttgtcattattccggtccagtccatatagtaccaatgtccacctatatactgccaacctgttgtcatcattccggtccagtccatataataccagtgtccactaatatactgccagcccatagtcatggttccactcttttccaagaaataccatttaccatttatgtactgccaacctgtcttcatagctccacttgcatccatgtagtaccaattaccgtttacatattgccagcctgttgtcataactgtatttcccgcaaaataataccagtttccgtttataaactgccagcctgttacatactgaccatttgcatcaataaaataccaatcattaccatataggctccaatatcctatgacgcttgtaatcggattctcataattcttgtatgcaaaatccaaatccacatttcccgatatacccggaattctggttgtagagctacactgccatatacctcttttaatatttgtatcataatgcgaattatatcttgcaatccacaattcctctcctgcaatctggcttacatctatgtagttcttataccagttctcattgcaataaaccataggagtgtaaccatatctcctgatttcatcacaaaatgcttttgcaatagcaccaagctgcgccttagacaaatccgtctgcgaagaatcctccaaatcaatagctacaggatatgagattgtatatccccttaactcacttacaacgtatcttgcatccgaaacagcatcactaacgtttctcgcttgactatatatatatgcaccaataggcataccagctttatttgcatttgaagcgtattcattaaatcttttatctgtaaaatgatgatatgaatcagaatagtagcttcttgaaactctcagcattgcatagttgataccactatttttcacagtagtccagtcaatatctttttgataatatgatacatcaattccgactaatgccccattagcatagttggactgtacccatgccccggatggcttatggtaccaccaagcacctaaataatactgccagcctgtaagcatctctccacttccatcaaaataataccaggcattattaatattgcgtgatccggtaaccatatatccattttcatcaaaataataccatttattgctaatatttacccaggaactacgtggatatgttccatctgaatactgataccaccagcctgcatcattcacttcccaatgcccctgattggatgctgttgctaagacctcatcatctgaatatgcctgttccagttcatcatattcctttcccattgatgatccggctgtatattcctcctgtgctgcctgtacagaattaacactcattgcaagcatacctgcaacggcaaatgctcccaaaatcttcttagttttatttgttactttttttctcactgttttatttccttcctatacttttaaaacattatagcacatatgagcttagagtaccatcttgattcaaataataccccagtatccagtattgcactcaaataaatacaaaattctaatgattatatattaaatgaggtctatgttatccacatagacctctcaaaaatattttatgcaattaatatataaaactatgagttaagcccaaacaccatcaagccctacccaatttccatcaggagtatatgtatttctcagcatttcgcctttacggaaataataccaagctccgttgtataaaagccatccgtcatgacactttccatcagagtctgaataataccattcatcgtatgtaatctgaccacctgtagtttgaatgtcatgataccatcctgtaaccataacaccatttgcatcaaatacgtatcgtggtgaagccttacgagccttattatactctgtccaattagtatttccattttcatctctaaatgcatcctgacttacacaataatcaatagtatctgctaccatataaccattatcactaatataataccaatttccattatatggtaaccagcctacatatttagtaccatcagcattaaaatacatccaattagtcgatgaataatttgctgatttttgactacaatcataccagcctgagaccattctaccatcgcatccaatatagtatttatggtctacccattgatcgccatacatatctccccaatcatcaaaataataccagcttccgccatatggcagccatcctgaatacgctgatccatctgcatttgtatagtaccagtcatctaaatatattcctgtctgataccatccaatgatgagcttaccatcttttttaaatctgtagcgtttgtcattaatagtatacattccctttgaatacatcctgccgctatatgtgttaatataataccagccaccatcttgtgccaaccagccatcttcatatgcagtaccatttgggtttgcataaaaccaatctcctgtaacatcaccatcattatcagtatatacatcccaagtccagccctgaatcatctgaccagaaggagcaaaagcacgcattgtaccattaatctcacttactctgctacgatacataaagccatcataagggctgaaataataccatttgccaccgatttcctgccaatctttctgcatataaccattagcatcaaaataataccatgaagaattaattttctgccagcctcttaccatatagccattagcatcaaagtagaattttccagtctctgtagaaacaaactgactatatgcccaagagccatcattaaatttatagcaataatcaggatatccatcctctggtccataccatccagtttttgctccataaactgaagtagcctgtgcaagctcctcatcggaatctgtctctgtagcaactactgccggtgtctcactctctgttggagtctcaacttctgctggtgtatctacttccgttgaagtctctgtctctgcaggtgtctctgtttctgcaggtgcctctgtctctgcaggtgcctctgtttctgcaagtgcctctgtctctgcaggtgcctctgtctctgcaggtgcctctgcctctgcaggtgcctctgtctctgcaggtgcctctgtctctgcaggtgcctctgtctcagaagctataggctgaatctctgctgcacttgcaagtgatggtgttaccatcgtcatcgcagtaacaattgccgctgtcattatgagtttgtttttcataaacacagtacctccttttttattatatatatataattttagtacttatgttgtgatattgcaagtaatttattaaaaaatccacaaaatgttacaaaatattttttcttccttagtaaatattatatgggtaacacttgcaacaatttcttacaagcattacccatttttataaaatgtcttaattaattaaattctctggggttttctcgcactctaagcaatctgacaccttttggaacccctcagtactatccttcttgaggagtacaatagctgtctggaataataatttgatatctgttctaaaactatagttttcaatatacatcatatcaagtataagcttatccttcggcgatgtattatatttcccggcaatctgagcatatccagttaatccagcctttgccctcagtctatatttaaactccggcagttctcttgtatagcttttcacattttcaagcatctctggtcttggtccaacaaagctcatatctcccttcaatatattgaatagctgaggcacctcatcaagtcttgtctttctaagtacctttcccacctttgttattctgtcatcatccgatgttgctgatcggttttcaacgtgttctttcattgttctaaatttataaacataaaacactcttccatattgtgttgcacgtttctgtttaaaaaatacggttccaccatctcctaattttattgcaatagaacttacaatccagattggtgaactaatcaccacaaaaatcaaagagaatataatatcaaatattcgttttatcactctctgttcaaaagtcatattgctgacattgtgattaagaaacgatacgtcatccagtaaataatgttctgatacattttcaaccaaatcgcatacatcaggatttatatatatatttatcattcgctcataacaaaaattaattatatcaggttttttatctgaaggaatgtcatatataaacactgtatccatatcttttatgatatcataaagatcttttcttctataatccactacccttttaatgcaatactgctttttgtaacgttttacagaagaagaaagctttgacaggtctgactcctgtgtagtaatcacacaacagctctcaggatcatttattgcgaaaaatatgccattaccaatatgaacaaaaacaataataataacaacatggactacaattacaagtgccaaagtacctatatcagaaaacttgaatgcggaaacatttggtgttattgtgttcattatcattaactggagatatgcaacaaaatctgtaaacaatgttgctaataccaacgaataaattatcggcttactctttcttctaccaatatcatatctgccatatatcgctgtcattaagagtccaacaaatacatacgtaagaattgtagttgccatggttcttgaaatatttaaaactgcaaagttatttctcgaaaacagaatgagaaaactaaacagtaatgataaatatagcaagactttcaatataaaaataatagattgaattgtttttttaaaatattttttcatgttttttatcctattctgcaaatttttgttcaaacaagtttctggtattattcttcatacaagctaaatcatcttttgttatattaagaattcttgaaacacaagatttgacatcatgtctgtcaacatttatgccaatgttgcattcctctacaaatctacttgtatcaccctgaacagtgttaataatcggaagtccgcccctaaaatacgaaatagacttcattgtaattccaatcgctaaatcttctcgtaaaacattaactccaaaccaacactgattaaaaatctcttgcaatttatctatctcatatacttttccgtgatcaatgatttctatactattttgtttcagaatctcaaggaattcatcttttctttcaccatcaccaattatatggattcttgttcttttatttttcgcaagctctgaaacaattttttcaattaatgatatatcaatgatattgtttatactacctaaatagcataaatcaatttcatcttcggatactttcgtttctatacttgtttccgcattttccaatgtcaaatatttggtttccattggaagattaatcttttgagccgacaataactctctataataatcacactcaatccatatttgatctgcaaattttaaattcttatttctgaaatttctccaaatattgaatcccctgtttacaatgatattctttgtcttaaccggcatagattccggccacatgtcaaaaatgtccacaataatctcagcattattaatctttttatattttgctgaactttttaccaatgaattatttggcacttctacatacaccaattctggtttacaagccaataacatgtaaaacgttttgtaactgaacatcagatgactcaatatcctgcttattgataaattttttttgtaagagattacatgcagttgcttactatttttatactcattgaaacaatacctctttttggtcatatgatcaaaatcagaggttacataaattacatcataaccttttttaatataatcattaacaaactttcctgttctcacattataatggttagtagaacttataaaataagcagtctttggtttcttattttcccacggcatagctaaaacaagagccaatgaatacataaataatccaacacttgagtttaagcaaggattaaaatatgatatcacaaaaacaaacaaacagcctaactgtgctgccaaagctaataatctttgttctttgcaaaatacatcacgcaaaataatagtatcaaaagcagaaaataaaaaaggaataataaaaattataaagcctataaaacctattttacttaaaatatctaaataaaaatactcaataaaaccatcatttatatcattggatactcccaatcctccgcccaaaaatggatgtttctttatattttctattgctaaagtctttctctgttctctgatggctaaattttgaatttcagctttttcgtttgttaatttgtcatttttattatttttatcatttttattatcagaaggtttgtcaacatttgtatcattatcttctatttctgctccggcaaataaacatctatttatggccacatcaaccaaatttgctttttcagcgacactaaccgtaccaattaacacaacaactattccagcaacaaaacatgcccttatagccaatggtttaaaaaagtctctataaaataataatattaatactacaaatgcaaatattccaatagcaaatgccaagtagcctgatcgtgtatacgaaataaacacaccaaaaatatctaacgatgcaataaatatccaaataattttacgtttattttctattaacgaaaatacaatgcttaaagcaaaaccagcaaaaaaaagtctacttccagaattgaaaaaaatgcgagtcacccttcctgtcaattctgtaatcatgcatatattatatccatcaaaaaaatcatatgcccagtgtcttatctctaaaggcatctgcagataaaatgccagaataatacctaacacagatacaactccaagtgacaaacataacattttcaaaaatgaaatcactctattttttttatacataactgccatcattggaaaaactatcaaaaaattcaaaaaacctttgaaatcagacaaaagtattgttgtgttttgttttccaacaaagcctctaatagcagctataaatataacaaccatgaaaacaagtacacttattaaatacttattattcaaatattttttcaaatccaataatataaggacaactgccgctaaaaccgatattccgaaaaaaatcattctactttgaattccaaagctctttgtcagttcccctgttcctaataatacaacatcaaacatatacaaaactaaactaatatatgttatcatctccattactattttgattgttttacttgatttcatgaattctccttattaattcaatgccgtctcttctaccctttagcatttgtttcatttttttcaacttatcatcttcgaatattagtgttttaaaaaaaaataatctatatgatttcttttctgcctttagatttattatatctttatgttcattcatataataaatccaatttctaaccatataatattttctcattgctgaatgattaagtgcagtaaatttaacgcctaaaatactatatttttttccttttcccaattcatggctaagcttaacactaccaatctgaagtattctatacccatgttccttaagcttagcacaaaaatcatgatcaacaaagtctataaaaagctcttcattaaatccgcccacatcattccaagctgaaaccggcaccaatgaagctgatgttatgcacttatccacctctataacatcttcattattcaattcacttttgaaatttctatcaacacactgtggacatagtgaacccaatttatgttcatctaaatacttattatattcttcaattatattatccgggcatactgagtcttgatctaaagtcaaaacatattcgtattgttgttcaatggcaaattcaaacatctgattcaaagctttagcaatgccttcattttttccattcttaataattgttatatttttccagttatttaatacacaatcctcaatgttctttatattatccgaaccattatccacacatattaccctatcaacttgtccataaattgatgatatattctcttctagtcttgcaacgtctggattgaataatgttatacctgctaatatcatttcttctccctgattcttttatttatacatttcagcataatcgctctattcttaaccatctcacccaaaggtaaatgagtcatttctgatgcattatttgaatgtcttctatataaaagaagctgttcgttacagaactcaacttttccaactctttccgacaacaatccaatccactgatcatgcattggaatattatccggaaaaggaattgcataatccagtatgcttcgtttaaaagccatacagcaacctatatatgaattttttatcaagtttctccaatacccttttttgcattttttaaattcaaaaaaagagcaaccggaaattctcaaattagcatcaacaatgcatgcatcatgcattaccaaagtacaatccgtattcccaaaaatatctagtactgttttaactttattatctttccatacatcatcctgatcgcacaaaaaaataatatcgccttttgaatgtactattgcattttcaaaattcttaatcagtcctttccgaggaccatctataattctaattcttctatccttttcagccaaatcatcaacaattcttctggttctatcagaagaaccatcatctgaaataattatttcatcttgagaatcaagatttcttaatacagataaaatctgttcctcaatgtatttttcgccgttaaaagcagcaacacaaaccgaaatcatatttaacaaatcctcttttcttccataataactttatcattattgctcatacaagcaaaaacagaaaaaataaacggattatatgcaatttcaaggagatggtgttcagcaaatgacgctatagtcacgataaaaaatgctaaacacataatatatttctcattatccagcatctttttttgagccataaatataagcactataaccagcacaaaaacaatagctccatactcatacatgcatcttacaaatgaattgtctataaaaaaataattatctttagcaataatagacccaccatttccgtgttcctcaatatactgcccccataatttgatattatatgtcgacatagtctgggcaatatactttaatctatccgacagcacatcatttaatccaataatatatttattattaagctgatataaccatcccaatacaaacgaagctatcacaataaaactctcgcagatatctacaagtagccattcaatacgcttatttaatccaacccatttttttataatatagcatatagctattcctgtcaagaaaataagtagactggcaacagttgttctaccatcacatctaaaataaagaaaagctgcaatcagaacagatattaaagccattttccaataattcttcttttttatcacagaaaacaatactaaactaatgaataaaacatgagcacaaaaatccgtaggtgataaaaatccatatgcaatcctatttcccctgtatagacttggatatattaggttctcaacaatccctatttgacttcctagtatcgtaattaataaaaacggtatacataccattaggtagtcttttaaaattctatcaattggaatatcttttgctgctgctatcaataaacccacatacattaattcatgatagccacttaaaagcccacttataataaatggtgcaacaattgttgccataataatcagatattttctatttggttcaactaatattttacctataatatatcccagaagcactaccaaacaaatccatgtataacaacgtggcaaatgaatttgtatcattgttgtttcccaaaagaaatgtataagtagaaaaatatatacaatagagaagacttctttattatatttttcaataaaagttttataattaccaatcaatagcatcaattatcaccattattttctatatattatatattcatgatatggaactctctcctcttcaggtggtggagtcatatagtctccatattcttcttccaatacctttttagcctgaacgggaattttggtttttacaccttcaaatataatgtcctcaacatcttcgaaccattccttctcataatatgtaacacagttatcccatatcaaatccccgacatatttgctattctcatatgaatagctatttgtaagcacatcaaacttatccaaaaaatacttagttcccttcacatgcgaatacaagtaaaccggaaatcttaataatcgtttaacaaaactcttatttgttcccattatattcttactctgtgcacaaccaacacactgcatccaaaatgttttctttttttctatttgttttttagcaccattcttaacatttcctaatgcatctaaaggataaatgtctataaataatcccatccccgcatcagatagtccatccgttttaaccatcttaaatctagtatcacaaaatctttgtaaattaaaaggataatcatcggctgtatattttgacatcaacttaaatggatatagttcttcttcatgttcattacaatatgctacaaacttatcatattcaggtcttaacatgcaaacatccatatcatcatcccaaggtataaacccattatgtctcatatatcctattaatgttccatacataattgaatacttaatatcattgtgctcacatatctcatctattttttttaaaacatttaaggtttctttatgcacctcttccaaactcagttccctattcatctaaaatctgcctttctacattctcgatatttacaataacctttttagtttacatccaacatattacatagtcaagaactttgtacttttactctgcttttcttctgttctctttaacaaactccggcagcaccttaattccaataaacatgaccacagcaaaacataccaaatatcttacaaatatattatcaataaatataagatctactattgcaattatcacaatactaagtaaacataatgcaatacagctaactggaataatagaaaatctcattaatctataagaaataacaagatgtaatatcatataacaaatatatgcaaacagcgtagtatatgccgccgcaataaagccatatttctgtataaatatataattcgtaatgatattaattaccgccgcactcattgttccccacatgataaaacttgttttttgcttaaaatattcagatggaactattacattatatataaataatacaaaagcatctaaaatcatagggattgcaacatattttccaactgcatatttttgtccgcctattataagaaccaattctggtgaaattgacattactccaatagcaataatgaggaaaaaataacacaattgtcttgctctacttctgacagcttctatttctttatttttcatcttttcataaaaccatgtcatccacacttcagaaattgaatctgatataatagctaaaatcaattttatattaccaacaagtccatatatgccagcctcagactttcctatcattttattaatcattattctgtcaaattgggcaagcaacacctgtgatattccatgtggaataataggcaagctgtattttattccaaacttccaatatttttttctaaatgtcggtcgagcacgtttatataaatcatatataatatatactgtaacaagtacagtggaaattgtaattccaagtacccttccaaatcctcttgatgaattaaaaatagtcttaattaatattaaagaaagacctacatttccaattgtgcttgctaaagaaaccttaatgtattttttatactcataatccaagctaattcttgcattatataaagtaactaccgcaattccaaaactgtatatcacaagcataaccaatgtaactaaatcaagatccaataattttgtcaatattttattaaaaacaatagaaataaacaaggcaactattaaatttatccaatatattcccataattgatgatgtaaaatcatcaattttaccctcaaactcatattttgcgcttcttattgagctatgcagagccattccaataaaaacgaacaagactgcttcatatgcggcaaaaaccgtatacaaccccatctcttccgtagttaacaatctactaaatataggaatagccaaaaaatttatacctttaaccatgacatttcctatagtatatcctatgccagccttaaatactttactttgctttaacttcatatattttcctcaattaattttttgtttagtttacaactattagtgattaaggtcaagacttttatagcgtaaatagcttccgacaattaatgtcgaaagctataatattatgatatatcatatcaattaaaacttaaatgtattctccagtgtctcccacttctgatccttatcacttaaattgattggtgtgccatcctcaagtgtgtatccgcttccgtcggcgcttcccggatactctccgacaagctgtggccactcgatgccgattgccggatcattccatgcaagtccgctctcgtctccaaggtgccagaaatctgttaccttgtagcagaactctgctacatctgagagtactaaaaatccgtgtgcaaagccctccggtataaggaactgcttcttgttctcttccgtgagctctactccaaaccacttgccatatgtctttgaatcgcttcttaagtctacagccacatcaaatactgagccttttactgcacgcacaagctttgcctgtgggtattccttctggaaatggagtccgcggagcactccctttgtggagcaagactgattatcctgtacaaatactctgtcaatgcctgcctcctgcatgtcctttgaattgtatgtctccataaagtatccacggttgtctccgtgtactgtaggctcgataatgcaaagtccttcgattccacctacgtttttctgtactttaatctgtcccatgatttctatgtcctttctaaaagttaatctcctgcaaatatctgtgcagcgcatcctgccatgtaggaagcggcttaaatccattctccacaagcttgctcttgtccagtctgctgttaaacggacgtgctgccttcgacacaccatactctgctgttgtaacaggtgcgactgtgagtctgtcctcagaatactctgtatgcccaagctccactgcctgcttaaaaatttcctttgtgaaatcataccagctgatatatccgccctcgtttgtagcatgatagtaaccgtatttatcagtctctatcatatctacgagcagtcttgaaaggtcgagtgtgtatgtcggtgtaccaatctggtcacttactactgtgagcctgtcatgtgtcttgccgacattcagcattgtcttgatgaagttcttgccgttcactccaaatacccatgctatacgcacgataaagtacttctcaagggtatttgccactgcaagctctccatcgagctttgtctgtccgtatacgttgagcggtgcatagtccttgcagtcaggctgccatggtgtggtgccctgtccgtcaaatacatagtctgtgctgatatataccatcttggcatctatcttcttgcaggcatctgctatattctgagtgccatctgcgttgattgcatgcacctttgcttttttatcatcatcctcggccagatctactgctgtccatgctgcacagtgtactaccacgtcaggcttaagctctgtaattgttttttccactgcatcacggtctgtgatgtcaagtgatacatacggcatagttgtaactgatgtgccatcatctgctccgctgtactgtggtgctatatctgttccgattccttcgtaaccgcgtgctgcaaggtcgttcattacgtcgtgtccgagctgacctgcaactcctgtaacaaatactttcatttcgggtctcctttatgcttaattattatcgtgactaacatcaccatatatgcgcaaaaccaccagacaaacgataataactatctattcgcgtacatcttctcatagtagttctggtactctccactgatgattgtctcccaccactcacgattgtcaaggtaccatttgattgtcttcttgattccgtcctcaaacttggtctcaggaagccatccgagctcattgtggatctttgttgggtcgattgcgtaacgcatatcatggcccttacggtctcctacgaatgtgataaggctctcaggcttgttgagctccttacagataatctttacgatttcaaggtttgtcttctcattgtgtccacctacgttgtaaacctctcctacacgtccgttgtggatgataaggtcgattgccttgcagtgatcctctacatagagccagtcacgcacgttctcgcctgttccgtataccgggagtggcttatcattaagtgcatttgcaatcataagtgggataagcttctccgggaaatggtatggtccgtagttgtttgagcaacggctgattgttacaggaagtccatatgtgcggtggtaagcaagcacgagtaagtctgctgctgcctttgatgatgaatatgggcttgatgtatggattggtgtatcctcatggaagaaaaggtcagggcggtcaagtggcagatctccgtatacctcatctgttgatacctgatgatatcttttaataccatacttgcggcatgcgtccataagcactgatgttccgatgatatttgtatcaaggaatacctgtgggttttcgattgaacggtcaacgtgtgactctgctgcgaagtttacaaccatatcaggatgctcttcctcaaataatttgtatacggcgtcacggtctgtgatgctctcctttacgaaacggaagtttggattgtccattacaggctcaagtgttgagagatttcctgcatatgtgagacagtctaagcatacgatacggtaatccggatatttgttaagcatgtgaaatacgaagttgcttccgataaatcctgctccacctgttacgataattgtcattttgatttcctcctgattcccgctttttgcaagcgagatttaaattatttctattaacttaatctaccagctaactaacgcaatgtcgattttactataattagtacagttgctcgcggtattttccatcaagtacatcctttaagtactgtccatactggttcttctttacgagctcatatgtctttaatacttcatcctttgtaatccagccgtttaagtaagcgatttcctcaagacatgctatcttgcggtgctgatgtgtctcgactgtcttgacaaagtttgtggcatctacaagactctcatgtgttcctgtgtcaagccatgtgaagccctgtcctaaaagctctacattgagtgcctttttctcgagatagattctgttaaggtctgttatctcaagctctcctctggctgatggcttaaggttctttgcgtactctactacgttgttgtcgtagaaataaagacctgtgacacagtaattactctttggatgctccggcttttcctcgattgaaatagcctttccctctttatcgaactctacgataccgaatctctcagggtcatctacatagtatccgaatactgtggcgcccttaccactctctgcgttttcaactgcggccttgagtctcttattgagtccgtgtcctgcgaagatgttgtctccgagaaccatggctactgtatcatcaccgataaatttctcaccgataacgaatgcctgtgcaagtccgtccgggctaggctgtacctcgtaggtgaggttgacaccaaactgatgtccgtctcctaagagctccttgaatcttggtgtatcctgtggtgttgaaatgatcagaatatctctgattcctgcattcataagcactgacataggatagtagatcattggcttgtcataaattggaagtaactgctttgatgttaccattgtgagtgggtaaagacgtgtgcctgaacctcccgctaatataatacctttcatgttgttctccttcaaactgaaactacgtgctgcacttgatgctttcggtctgtagaatacactgacctgattcatcatttacctgcattataaaaggtgccccaagggcaccttcaagtacttttttatatttttagcatttttcacaaaatatatgcttataatatcctgttttttgaatcattttcgtgcaataaatacacctgcatcctttgtgatatggaaccctccctctgtcttctttctgacaaatgccgcaaattccttatagcggtccacaatatacctgttctggttgccgtggcacgagagcacatactctatcacaggctctgctttttctaccacaagctcatcctcgtatccatgccagcttacctcaccaaagtattttccaagtattgcctcaccattttctttaccaaattgctcatacagcctttccgctgacagctctatacggtcatcaaactgctgcaccaggtcgtttatttccttcatatgccgtgagctgtatgtactgcacacaaacacgccacctggctttagcacccttaggatttcactgcacacggcatccagattgtcacaatagaacagtacatggtctgctatcacgcagtcatacgatgcatccggcttatacagcctgtgggcatccatcacctcatatgtgaagcgcttgtcatctgcgcctacatttctcgtcgcatcccttaccatgccatacgatatatcagtcagggttatctgcatatctgccggtatcctgtctatgttctgtgtccagagagaggcatcaccgcagcccacctcgagcaccttttccccctcaaaaaagctacactcatcaaatacccagctaaaccagctcaccggattcattgagaaatccctgtgcagattgattctggctgatatatttgaagcatccctgtactgctgttttagcttttgctccatctcgtttatattgaccagctccagcatatggctccagtccacgcttcgcccctcgtctattacctctgaagcctcctgcaatgccgatttcataagcttcatctgctctatcctctcctccacgaggccaagctgcatgtgaagcgactcagacatgacatcgctgtccgtgtttctgagtgtcatctccttgatatcatccagggaaaatcccagatatttgaggaacagtatctgctgtagacgcgcaaagtcgtcatcattatagaatctggctccgttttcgtttacgtaggatggttttaaaatattgtgctcgtcatagtacctgacggtcttttttgtaatatgcgctttttttgcaaattctcctgaggagtagtagccgggtagtttcacttttatacctccattactttcgctccaaatatttgtcaagaatgttcaatatattgcttgttccatccttatacttgctagcaactaaattttttgcatcaatatttctaatagttttatttgctttaaatttccctgcctcctttttcttttcatctttcacaaccttctttcttagataaacacgctcaatatccttacaaaaccatattaattcatatttattatcattgcaaaacttgaaagcctcgttcaagaatttaattgcctccatgttgatatcataatcatcactatccaagcaacaaataactttggagttaccattacttgcacctttagcatactggtctatatttttattaatttccttttgtttattcttgaaattccccttaccatccatatacacctgtgtaaactttatattattggcatctatattataaaaatattcaatagtatccttgatatatatccaatccgatttacatttcttatttgtctctaaaacaaatattagctgcattcccattattcatccccctcctgtataccaaatgcatctataaaatctatagaatccacattgaacggagatccctctatcatccctttcctataaagattagccggtgaataattccctgattttttccacgaataaatcctatggtctcccgaaataaaatcaattgaattactatttcttttgagaatatccatcggtcctatattgtgtgtcgtaaaacacagttgcccctcgccatactccattaaatattccagtaaagcgcacagatagacatcatgaagattggcatcaaattcatctataaatacgattcctcctcgtttcatctctctaatatacatataaagcttcaccagcttctttatgcctgtactttcaaactccacgttaaccctatattcattgtaaaccattacaagctcacagacatacatgtctccatcttcctttttttctatttcaatccccaccaaatccgacttaaaaatgtgtaaaaactcgtacaactgatgaacttcattttcaaaataatcataactatccctgttaacaaaatttttctccgcagctaacatattcatactctctgcatccatatttgaagcctcatacaacaggctatctaccatttcattgccttcatatgttatatctccgtacttcatcatatgtgcaattataaatggtatatgagtatcctcattgtcaagatatacatgtagctttgttccaaaattatataaaataaccaaagccggaacaaccatttgaacctttttatcaaatatttttttatctataattttttttacagcaattgagcaaaatgatgatttatctaatagatttattgttttttctgctaacatactatttgtcttatcacttgtatcaaaatattttaaatccaatgctccatcatttactttgtacaaaacactcatattttcttttcttgttgttgcatttttaaatgaaagctcttcactttttataatatatgtttccgattctttttttgctaatgctacattatatcgaaataaccacaatttttcctttgttcttactacatattccacttcaataaacaactcagataatttcttattcacaagtgaatccagcgttttctggcttattggattatttaaatagttagaatctgttaagatattttttaaaatctgaattgatgacatgattcctgattttcccgaaccattcattccgtatattccttttatattaaacccttgcgtatccatgtcttttgtaattgtttttttgtaaaaagccaatgacaccagcttatccaacgattttattcctttaaccgaatatttaaccaaatacatattcttcatctttgtatcctcctttttattcactataacacattatatcaccaaaataaatacaatatgtatttatttgtacgtaaaaatgttttatctcttgcttttttttaatcaacacttataataatttatataacgcaaattaagtaggagaacacaatgaaatacgattatttaatagtaggttccggtctctacggatccatcttcgcccatgaggcaaagtccaagggcaaatcagtgcttgttgtggacaagcgtcctaacatagcaggaaatgtttacaccgaaaagcaggagggcataaatgtacacatgtacggagcccacatattccacaccaatgacaagagggtctggaactacatcacacagtttgctgagttcaaccgtttcacaaacagccctgtggcaaactacaagggtgagctttactctatgccatttaacatgtacaccttcaacaagatgtggggtgtggtgacaccggaggaggctgctgcaaagattgaggagcagaaaaaggaaatcaccggtgagccaaaaaatctcgaggagcaggctatctcactcgttggccgtgatatctatgagaagctcgtgaagggctatactgagaagcagtggggccgtgactgcagggagcttccggctttcatcataaagcgtcttccggtgagacttacctttgacaacaattacttcaacgctctttaccagggtattccaatcggtggatacacaaagatggttgaaaatctgctcgacggcattgaggtcagattgaataccgactaccttgagcacaaggctgagcttgatgctcttgctgacaaggtggtatacacaggtccaattgacgcatactttggctttaagctaggtactttagaatatcgctcagtgcgctttgagaatgagaccctcgatattcctaacttccagggcaatgccgctgtcaactatactgaccgtgagactccatggacacgtatcatcgagcacaagtggttcgagttcggtaaggatgaggatggaaatgatctgccaaagactattatcagccgtgagtactcttctgagtggaaggccggcgatgagccttactaccctgtaaacgatgagaaaaacggacagctctatgccaagtataaggagcttgccgataaggagaccggtgttatattcggtggccgtctcggcgagtacaagtactatgatatggatactaccattgcttctgtacttgatatgtgtgagaaggagcttggctaatagttaagcttcccataaaatgctttgtttatgtcatgcaaaaccgcccatagcatattttgccacgggcggttttatttacattatttttttccggccagatttatctcagccgcaggaatatgctccctaagacactcatatccatactccttcgaatatgcatatatagccggaagctgtcttgacagaaagagcgccggtgcttctgtcaccgagtacgcaccacagtgcccaaactcaagaacatcaccaagctcaagcttcttaagcttcacctcgcgtaccagcacatctgccactgtacagaggcttccgcagagtgtatagtctgtgtccggcagttctgtgaattccacaccggcagctctatatatactaatcggtggcacctgcattgccatcctctgcccgaagtaattcaggtggtggattcctccatccagaatcgcataattggcatcgcctgtcgatttaagatcctttacctgtgtgtagtatttaccgcatgaggctgcaaggaaacgtcccatctcaatgccaagcggatattcctcggcaaattctctaagcacctctgctgcctcatcaagtgattgtttttccttttcctgccagtcttcctcaaaatactccacacaaagcccagggccatactctacaagctgtggctcaaagctgtatttgtcctttaacatggcaagtgcagactttattttttccaagtccttatttattttgcgcaggctcttctgtgtgccggaatagtagtgaatgcctattaccgtgatgcccttaaactcatccggatgcgaaatgatatattcaatatcctcaagcgacatgccaaactggttgccacttgtcaggcgcagtatgacctgtgccttcttttcgaccaatccggcttcctgcgcgccttcagacatacattcaagcatcacttctgatatcagcgccgcatgtcttatgctttcacaggtcagtatgccggcgccatatgaaactgctcgctctatatcgcatttttccttcatcacacctgaataaatgatgctctccggcttcacgccaagtgctatacatatctcaagctctcccgggctgcacacctccacatggtctaagccctccggcagcctgtgaagcagaaacggatttgcctttatcgaaaagcaaagcggtatcctacgtcctcctttacaatcaagagcagcccttatcatggctgctcttttcgcaaactcgtccgtatcaaatacatagtacggtgtctgtctcatatgctttattcctccacaagctctttcacaagcttctcgattgcatcaactgagttgaaattctcaggaaccagatcctttggtctgattgtgatgtcaaactcatcagtcaactccgatacgagtgaaactatatcaaatgactcaagaattttgtcatcgatgagctttgtctccttctcaaaatccacatccggtcttaattcctctaaaatctctaaaattgtgtctctcattttacatttcctccagttttttcatatcatattttccgtttggaagcttaggaagctgctccagcttcttgatcttccttggcaccataaagcccgggagctcgtccctcaacgccagcgcaaggcttctcctatcacagtcacctgtgtagaaaagtatcagcacctcttttgctttattatatataacgcagctttctgcgactccctcgaccacattggcggcatgctccacctcgtcaagctccacacggtgtcccatgtgctttatctggcggtccatacgtccacagaaatgaagtatgccgtcctcatcgagccttccgtaatcccctgtgcggtacatccgctcaggataagccctgttgagtggattgagtgtaaatgccgcagctgtcctctccggatcattataataacccagcgccaggattggtccacatacacatatctcgccctgttctcctacagccggctcatttccatgctcatctatcaggaaaaccctgtaattgtcataggcttttcctataggaagcacctcgtcctcttccactgtatgatccacactataatacgtgcacgaagcagttgcctctgtcggcccatactggttcacaaaatgcgcttccggcagattttcctgccatttcctaagcaccctgcacggcatcactgagcctgagaagcagatttttctaagactcttaagccctacttcctcaaatgccccaagcgatgtgaggatggtaaatgccgaaacactccagccgacactgctgaccttcttctcattcatgtaatcaaacagggcattcggctccataaagtactctttcgggataatagctgtgctgcagccagtcttaagtggcagataaatgtctctgattgccgcgatatagtcaagcggtgactgattgcccaacacatcactttcctctatatgcatcacatcacaatatgcattgatgtatgtcataagtgacagatgcgatgtcatgactccctttggattgccggtggagcctgacgtgtagatgatatacagtgggtctgtcatggacatctgcctgcggactacagcgagcatatcgttctcactatccgtcacagcgtctcctgctgattcactgattttacaattactatcagcacacgccacctgctcgaagcgcgatatatcctcagcaataaatatttgcggtctatcgaagccttctgcctttgccagctcatccactatgctctccacatgctcacgactttccctgtccgcaacaatagcccctggacacagattttcaagaattttttcaattctcttgtcaggaagcgatgcatcaatcggtgcatacggtctgcctgcatataccacacccaggaagtatgccggtgtcaccatttttcttccggcaaatactgcaacaggggttctgtccactccaagctgttctaccagatatactcctgtatttcttgctatatcatacacctgcctaaatgtaatgctgcattcagtatccgaaaatgcaggcttgtcaaggtatttttctactgtggcctcaagccactccagtacgtttttcatcttagtcctctttcatgcattaataaacgttgccgaaaaaattatagcacataacatccgaaaaaaatgtcatgtgctatcgaattaagaattcttaagaaagccttaatttttttctgtaggtttttctatatttgattctcctattaaatatatcggtctgtcctttgcctcgagataaagctttgacagatataatcccaaaatgcctatgctaagcagttgtatcccacctataaaaagtataataacaacggtcgaagcccagccggctaccggatctccgaatacaagtctcctgataatgataaagagcattgcaattattgcgacaataaagctgaacactccggctattgaagccatgtatagcggagcgttggaaaacgccactattccgtcaaggctatacaaaaagagctgccagaatgaccactttgtctcacctgccaccctgtttacattctcaaactcaagccatttgaccttgaagcctacccatccaaacagtccctttgaaaaccggttgtattccttaagcgacagcagtgcatccacgtatttcctgttcataagcctgtagtcgcgtgcaccatcaaccatatttgcctttgaaatcttactcatcagcctatagaactttctggcaaaaaaagatctgatcgctggttcacctttgcgtgtcactcgtcttgtaccgacagcatcataaccctctttattaaggacctgatacatcttcggaagcatttccgggggatcctgaagatctgcatccattattgccacatattcccccaccgcatgctgcaagcctgcatacatggctgcctccttgccaaaattgcgtgaaaaagatatgtattttacaccggaatcatttgcggcaagctctttcgcgacatcgagcgtcccgtccatggagccatcatccactataatcagttcatagtacaatcccgctgtctcactctcttgactcatctgatcaaacacctgagttattttattataaaaaagaggcagagcctctttctcgttaaagcatggtaccacaatgcttatcttatttttttccataccagccaccctgcatataatatcaaataaataaaaaatccgattgctgctcctgccgtatttgtcacaaaatcatcaagctgacaatatcccctgccggtaaccagctgcgtgtactcaattgctgcgcttataaaagcaccaacaggtattgtaaaccatctcatccaatttttaaaaaccaatggaaatataagcccaaatggtataaacaatactatattttctataaaataagcgtgcatctgaagtgtcatgccccaattgctccacagcaccatatcggcgacgccggttctgcttcccggctcccttgaataatacactatcattataagcgtatacatataggccacaaaggtgccgcagaacagcatatgccagattttgcccactatcttttttcttctctcatctgcctgtgatacctctctcattgtgaaaagatatcgcagcagacacacaaaaatatacatcgcaatgcagattaaagccaaatataccgctgacggaagatatttgaacttttcctgtatgtctcttattatataatcctttaaactcaatgtccttttttatgctccttgtaggcacgaatgaactccagctgtcgttcatcgtcctttttctgttcgtcatcagacatatgactcactttaataattatacacaatattatgccaattacaataataccggcacataatataaaaataattaagatttcaggcatagactatttcctccggcagaatttaattactattctctctacagattaaattatatccacttaatttatcttaattcactcatttatgaaccctcataacagcaaaagctgcatgatattctcacacagcttttgtatattacgtgtattatctttggcattaacctttattttaattttgcaacgaccatatccacatatttctgacagatttcctcgctctctgcctcaaccatgacacggataacaggctctgtacccgactcacgcacaagtatacgtcctgtatcgccaagctctgcagtaacctggtcgacagccgcctgaacctcaggattggcaagtgcttccgccttgtcagctacgcgcacattttgaagcacctgtggatagatattaagcccctcacagagctggctcatcttctgtttcctagccatcatgacctccatcatcttaaggctggtaaggataccatcacctgttgatgcatacttagagaagatgatatgtcctgactgctctccgccgatgcggcagccgttctgctgcatgtactcatatacatatttgtcacctactgcagtctttgcatagccgattccaagctcatcaagggccttatagagtccaaagtttgacataactgttgtgacaacagtattgttatcgagctttcctctctctttcatgtactttccatagatgtagaggatatggtctccagtgattacattgcccagttcatctacacagagacatctgtctgcatctccatcgtatgcgaagcctacatcaaggccattgtccaccacgtacttctgtaagccctcaatatgtgtagagccagcattattgttgatgtttagaccgtttggctcattattgatgacatagcactttgctccgagtgcctcaaaaatagactttgccatgttccatgagcttccgttggcacagtcaagacctaccttcatgcccttgaatgagtagacaccaagcgatatgaggtatcccatgtaacggttacggcctgccacataatccactgtacatccgattgcatccttatgtgcataaggcaactccttccactcctgaccaaacaggcgtagcttgccgtctatatagtcctcgacaaggagaattgtctcctcatccatcttctctccattgctgttgataagcttgattccattgtcatagtatggattatggcttgccgaaatcatgataccacagtcaaaatcatcggttcttgctacatatgccactgatggagttgtggtaacgtgtaatagatatgcatctgctcccgatgctgtaagtcctgatacaagtgaatactcaaacatgtagcttgaacgtcttgtatcctttcctattactatctttgccggctcatcgagctgcttctgcttcttaagctctccataataccagcctaaaaatctaccaatctgatatgcgtgttctgctgttaaattgacattagcctctccacggaagccgtctgttccaaagtattttcccattgtcgtccccttgtgaataaatttttcttatattatacacttaataaatgtgtttgtgtagtaaaataagcttatttgttaaattattctacttcataaaatcaattgtttataaatataataaaaccaacatatgtatataaaccaaagctacatagatatcttatggcactccatataatatctcttctcattcgcttctccaattgagaatgtctttctgggcagcaccccgcccgcatttattgcagggaacaatgtgcttttgtctatcgactgaagaaaaattccacatcccttagtctccttaaccagtccgtgaagtgcctcatcaccatggatatagtctatttccacattgccatgtgtctcaagatacttatctaaaataccctggagtatctcaaccgggaggcggtcacctctatttgtgatattaattccggaattctttattgaggtagcgcctgattcaacatactcaaatactatctcatcaccctcagcgctctcaagtccttgttttgtgatttcagcttcgaaaaacgacagcatatcctttacatcaacatttgtaagcagtctgtgaataggcttaaactcaagcgcctcactgtgcagattacagatttccacaagagcatgccttgcaggatgagttttcaactgctcctctgtgaattttccggattttttgatattttcccagcatgtcttcgctgttgcaagggaatggtttccatcacctactgcaaacaaaaagcctccacagctattctgttttgctgcgaatgcctctgtcacctgctttgctgcctcaccctcaacagcatagccgcggatatgtccgcctccctgcataagctctgtatcgtaaagcttacgaagagtgtccctgatggcatacacatattcgattattccatgctttacagctgctatatttactgcatcttcctgtgtagcaccctggcatccatcaatcttttgtctgtctataggatcatcaacaagcagcataacatgtggcagctcaatagctgcattctctcttattttcactctcggaggtatacgtgagattactgttccctctgttgctctgatgagagtcttctttttcgggtcgaaatcatagtcatccagatcaataagtcctactattccaagacgcacccctgactccgtagtacgctcaacaagcacatagccatctgccaccacttgctttaaggttccatctgtgagatatgtctccatagtggtattaatatatttgattctctcatcatccgtcattgaagcatattttgttttcctgccggtttctttgtcatttttgacaccatcccctgatgaattgcaatcattctcctgattcgtaattgttcccagataaatttcaggaaacaccacattaagcgttgacggtgcatcagccacatacttttccacagcatcccaataatctgcctggcttgtaaactggtcacaggcaataactgaccattttttcatatctatacaatcgtttggcaaaagaatatttgccggattgaaacaatttgacatatcaacaattctcctttaaatatacaaaatatataacataaatccgctatactctatagtataacggatttacttttatttgcatatattaaattccttttgttgttagaattcttcccactgcatcatctaatttttctgccggtatctcgccactgttaactgcagacaacactgcattataactgctctcaaagcctgttgaaacataaagcatgctcattcctgccttaacagctgccacagccgcctcatcctgtgtacataccttattaagagatgcgtctgataaatcatctgtaatcaaaaggccattaaaacccatggtagttctcatatagtttacggcacctgctgatgtagagcatggcgtggtttcctctcctgtcacactctgacaaatcacatttcccatcatgactgccggaacacctgcttcaattgccttctgatatggcacaaaatcagatgcctcaagatcctccagcttatctgtcatccagagcattcctgtcgccgaatctgtagtagcctttccttttccgggaaagctctttgctacagaattgattcctgcaccattatagctgcttacctgtgctgcaacacagtcacctacagtcgctgactcgctgccaaatgcatatgtatcgttatctgcattatcaccatatgctatatctgctgtcggcccaaaattcatattaaggccattggtagccatatatgaacctatctttcctgcactgctgcccgctgcgtcagcatctccaagctgtgatggtgcctgctgtgcctcatatccattagctgaagcaagaggaagtctttctccaccttcttcatcaattgcaagaaacagattcacgcccagtcgctcctgcgaaaatgactgcagactgctcatcatctttgtaactgcagcctcacctgagaaattctcctgtctgaaaacaaaaccaccaagaggatatgtaccaatagctgcctttgtcttgttaccggcctgagtgaactgtgatacacctgtaatctcctcaggtctcgtaatgaatagctgggctaccttttcctccgttgtcatagaagacagctttgtcttgacagtatctgacggagtaaatgctggtgctgcctgctgtccatcagcttgtacctgctgagttccattcgtctcctgagtaggattctgtgtctcctgctggctttctgttattttcttattcgcattattccccggcatcacaaaatgcactgctccaaataccagcacaactatcagtgcaattacttctattgtgatgaggtacttatctccattttgtctgaagttcatatttaatccccaaaatttgtatttgttaaatcgttattaggtccgcttacttttcctgataatgcactgctgtattcgtttacagttgcactaggagtatagcctgtctcaccttcaaggaactgatgcactcctgtagccatgtctgcaagtgtagtaggcacctcaacccatgcaccatcaacctttccaccatagaacacctgtggatatgctgtagaatcctctactgtatagtctgcaagatttttaaatactgaaagaatctcatcagtattatagttagtattgacatgtccaatcagatctgataccatcttaatctttgccgctgtattcatctgcttagctgattcaaaaaccttgaacagcactgttctctgtctttcagcacgcttatagtctcctcctgctgtataacgtattctggaatacgcaactgcctgagttccatcaagagtatatgtgccggctgaatcaatatgggatgagcttgttccacgaaccttattgacctcatcaatatatccgtttatcacctttgcctcagatgcatcaatatcctgtacaatgcctcctacctcatctattatttcaccgaccgtattgaaattgactgtaacataattctttatgtctaagtccagatttttgttaagtgtatccactgcaagctccggtccgccaaacgcatgtgcatgtgtcaccttctggtatccatgaccatcaatattcatcatacagtctctgaaaatagataccatacggattttcttagcatcatgatcaaccctgactaccataatggaatcggaacgtgttcctttatcaagctgatctgagcggctgtcaacaccaaataacgcaaattcctctatacctgatttgtctgtagtgctgtcatcctcagcctgagtatcagcttttgtcttaactgcctctgtacccggctttatgcctttagcttctttattcttaacattactgctgttaatctttacaagtattatcgctataatagcaataagtacaatcattactgccgtaataattatatttttcttttttttcatctgcactattctccgtcattcatatgtgtctgtgcctgttacttttcgtcctcatctctgccataataattgccatagtaattaccataatagtttccatagtaatgaccatacttagactcctcaaacctgcacttattgagcacagctccaagaatctttactcccgagtcctcaagtgtacgctttgtattaatgattgcacggctgcttgtaacattctgggcagcaactattactgctccgtctacattctttccaactacggccgcatcaatcgcagctcctgtaggaggagtatcgacaagcacatagtcaaagttcttctctccaaactcgataagctctttaaactcctctgtctcaagaagctctgtaggatttggtacctcatgtcctgcaaagagaataaacactcctttgatgtttgtcgcatatactactttgtccaaagatacctgacctgagagataatgtgagagtccgtatatctttccaccgctctccactttcgctctgagtcgtcctacaaggactgacttacgcatatcggtatctactacaaggactgacttcttagagtccgccatcgaacgagccagatccataactacggttgtctttccttcatttggcacgctgctggtaaagaggatggacttcacgccctttccactgaaactgatgcttgttttaagagctcgaagagactccttcattgtatagctctggtcttttatctgattaataactattgtttccattaaactgccctcttcttactcttgctatcgtctgatttagatgattgagttttcttcttttttcttctctttgtcttggctccatcatactctgtctcatcaacaggaagtgatgcaagcaccttgaggcctgttctggtctccatatcatctgcattggaaattgtatcgtcaagcatgtatccaagtacaactatgccggtagcaagaaacagtccgagtacagctcctataactgtattcttaaggatattattattcaccggtgtctttgaagcatatgctgtctggataatctttggctgtgactgatccatattgtcagcgatatactgtgatgaaacctttgcaatctcatctgccactgtctttgaagcttccaaatcagtgtctgtaactacaatcttgagcacacgtgtatctgtcggattctctattgaaaccctcttgctaagctgctcatatgtctcgtccatatccagattgtcaattacctgtgataaaactgtcctgcctgtgataacgtactcatagtcgtttgtcaaactcgagcctacctgaatatcagcaagactggtgatagatgttgacttggtcagtacatacatctctgcagatgcctcatactccggtacaaaagtaatcttggagtataatccaaatactgctgcaagaagcaccattgatgccacaagtgccttccagtgcttcactaattcgtgaaacagcgctactaaatcgatttcaatttcctgatctcttattggttcgttgttttccattttcctaccctttacaaattgtaacattatttttcggtttaatcctatgttatattactacacttcatttcttttgtctatttttagaagtcacaaaaaaaatattaagaatatgtcatattttgtaaataattatgcaatataatagaaaagtgccgtttccggcacttttctttgttgtattttcatttgctatattttatttgttcctgttctattgttgctgttctagttctgctgtggctgttctgatggttcagtcggtgccaccggctgtggttgtggttttgaatttactgtaacggttattgaactgcttgcgctattccagcctgccatttcacctgctatagctgtaatctgtacgctaccagccctgtggatagtcacatttccggcagcatccaccgatgcaatcgatgtatcacttgactggtaagaaagccctgctccgtttgaagcacttgctcccagagaaaatggtgcatctccctctgttacagttttattaccgcaacctattgtcacagatggtgtctggtttggctgtggctttgcatttacagtgattgtaattgtcttgctgccggccttatagcttgtagtagcctcagacttgacagtgattgttgcagttccgacacctgctatcgtcacattaccgttctcatccactctcactacaccattattatcacttgagtatgtgagctttgcattatcctctgctgtcacaccgagattgaatgctccgtcgccctctgtcacattataagagtcagctccgccaagactctgtgctttgccggccaccttgtcaacaccaccatatacaattactttttcatctaatgttacattctcatatagcttctttgcagctgaataaggcatatttatgcagccatggctgccgctgtacaggtagatatttccaccgaaagtacttctccacgaagcatcatggaacccaattccaccattgaatggtataaagaaattaacccatgacttgtatccgtctccccttaagtatctatccttatctcttgagaagatagaatacactccggtaggtgttccatgaccttttgaaatacatcctgtaacacactgacttgatactataagctctccattcttgtatacatataccatctggttggtaagatccacttcacaataattgccaccatatgtgacatattcacctgtttcttcttcctttgcctcactgtaaactgcttccactgttgcagactttttattgtttattgcctcagcaatcgcctcatacagcttatttccatctacagtctgtcctgatgatgctacaggcacatttattatacttccgcctgttgtcttaaactgtcctgttttcttctttgacacatcatgctttttggctagctctgtacaatatgtagccatattctcgccatcaagcgaaactgacattccgtcattgcccactataagccactgggctatctgatcctttcctacagcctctgtagcagcttcacctgttgccggtgtgaaattacatgtcaccgtcacatcaagatatgcattggcttcttttaatgcattctttacctgctcgctgtccgtagccttttctccatcaacatatcctgttgtggatgtaagctccaccttatccttcagctcctttacagcacttgtaagatttgcagctgcattgtcatacacaggcgcatctcctgatacaccgtcaacaccctcaaattgtcctgcctctgcattgtagactattgtagcacgatatggcacaattgattttatatcaaaggtctgtgtgtctgtcgcagccttcttttgttcgtcatcatttgcatctgtatccgtatcgctctgagccgtagcatcagactgtgactgcgtttttgcagtgatataagagtctacaagagccgtctccagctcatcagacttgtccattttaaaaagcttcacctgcttttccggttccttatccttattggccgcatttatcagttcctgaagatctgctttgtcattgtacttaagccctaaatcctctgctgtcatatcaaatgatgtatcgtcaagcttcactgatatcttatacttgcctactgcagtctttatggctttctttgcttcgtcagcagtcattccacctacatcaactgatgcaagcttgtacttttcagggaatgtcttgtatgctttctttccacagcccgccattcccagcgccataagcacacatgccaaaactaccaggagttttatacttttcttcttcatctttgtcctctttatcttaatcttaatttttatattattctcacagcaccatattttatcactttcttatatatgcctcaagtgagatttgtcacatattttccgattatttaaacatattattcatcattatgataacaaaaagcttcctaatgacgcacaatatgtaacaggcgtataaaatagttctgataaaccttatcgctcatatgcattttattcaacatacaaaatactttataattcttatttacacatttatacatatctgtattctttttttcgatttgactgacaaacagcttcatcctttttctaagctgttttttatcagtgtttctaatcaggcaaagctgcaaataatcgttgataaatttgcttgttttatcaaaccacagctgctttccgcctatactaaagtgctccgcatcccggcctgcctcaatcagcctcatgataaccttctcataatggtcaagcctcttcagtgagctttctatcgaaacgctctgatttacgtcaccgactctatactcataaagtgccttatcatatgcatagatacttttggcatatgccattgggattattgaaaactcctgatcctcgtaaaataccccctcagagagtgtcagtcctgtatttctataaaactgcgtattatatatcaccccatgcagactcagcccccaccagaaatcatacagatgctcatccacatatcctgcattatatggtccaccattttttgttatatatttatcgtcgtatggatactcatcagtattttctctctgcagcacatatgatctatagctcatcagcactgcatctgcgaaattctcatgtttattttcattatctttaagataacaaatagtttctttcaacacatcagtgtttacccagtcatcagcgtctactaccttaaaatagcttccttttattatttttactccttcattaattgccgagccatgaccaccattttctttattcagtatccggtacacgtcaggatatttatttacatatttttgtgcaatctccacactattatcggtagagccgtcattcacaacaataatgtccagcatatttaaaagagagttatcatcaataataaatgatgataaccctttatccaaaaactttgccgcattatatgtcggtattattattgatagtatctttttattttctgtttccatatcctatctaattcctgtttctatatgttaatttccacttatatcgctgtctgtcaccatatttgacaatggtagtcagtattattttctgtatagtctgtctgctctgccaacccttttggcaagctcaagcagctttgcaaattgattctcgtaaaagctgttgctcacatgcagcttattaaacagccgaaatactttatatttacgctgtactgcctcatacataagtgcacttttttgagcaagcttcatgttaaactgctctactatcgctcttccggattgtctgtcggtattttttatcaaagctatttgataatagcttgtgattatgcccgacgtctttctgataaagtgttcctttccaccctgtggcatttttgcaaagctcttctctgcctcaagtacattaaatataacctgctccaaatccggaagacgcttcacctgactcgctgctgaaacactttgatttacatctccaaccctgtatacatacaactcttcctgaataaatctgacagtttttgcatacgaaaacggaacggttgcatactcctggtcttcgtaaaatacatgctctgtgagcttatatccaagtgctttatagaaccctgtgttatatatcactccgtgaaatgatagaccatcatatacatcatcccacatatttactatatcctttaaattgtactctcttgtaaaatcaggcacactcacatctgccggtctgtactcatcctttgatatgtcataatacctgaagctttgtatcaccgcatccgaatctacatgctcgagatattcaaccaggtgctttagcgcaagcgtatctacccagtcatctgcatcgaccacctttaaatactttcctctcacatgctccacgcctgtgttgattgcagaaccgtgtccaccatttgttttatttactatgacaaaggtatccggataccagtccacaaatttctgcgccacttcaacacttttgtcaggtgtgccgtcatttacgactatcacctcaagcttatcgagtatagccttgtcaatatctatttcctcaaagcggccctccgttgccattttacagttgtgctgtgctgtctgtgcatctgtatccctgcataccagaaatgacgacagccccttattcagaaacttttctgcattatatgttggtattatgattgataatattttactcattaactgttctatccgtcctgattactattattaaaaagagtattgcatactcattaacgcctattcatgaaattaattaccacgcagtctgctatagacccatgccgccatcggaaatatcttaaagcctgtttttctaagcatccagacgctcttcctgttgcacacctggtacactcccgggtgctcctcacgcagcatctcgtcaaacttcttcatctgctcaacgttccttgtatcattgccctttgcaagaaaaatctggtactcatcatcgactgcctcggctataccgcgctcaaggtactgcttcttgtaggtctgcagattgccgtgcacgttgttgtactcaaacagtgcatcaagcaccttaagatgctggtcatgacgcttgatcatcatctttatgtccacgctctgaccactccttccaagtctgtactgatacagtggcagaggtgaaaacgtgatgcttgtgcagtatggtataggatagagtatatactcctggtcctcgtagaagcagtgctcatccacacgaatgtcattcttctgcaatacatcagtacggatggtcatggaatgtatagtaatcagcggatccatgactgcctccgcaaagccccactccctgttatagtgataagagttggacactgcctttctgcgctttgtgaccttctttgtcctatcatccaccaggttgaagtcattggatatgacatccgagtgcgtgtgcttcaaaagctgtacaaattgtggcaaaaggctcttgtccagccaatcatcaccatccaccaccttgaaatactttcctgttgcgcgcggtatcgcatagttgatggtagatccatggcctccgttctcctttgagagcatcttgaagctgtatggatatttctgctcgtaggtatgtgccaggctggctgtagaatctgtggaaccatcatccactatgagtatctccagacttctgagcacagacaaatctataaacgagtcaagacagttctttatatacttttcaacattgtaagccggaacgactatggttaaaagcttctccatatatatgtttctccatgtatacctgtttccttgtgtactactctccgagtccatccttgatgtactgtataaggtgttcaagcgcctcactctcatcctcgccattgcagataagttctatctcatcgcctgactttatgcatgctccaagcactgaaagtacactctttgcattagctacatttttctcgtcatatataaatgttacctttgatttaaatttcattgcctctttgcagagattgccggccggacgtaaatgtaatccggtaggattcttgattattattttttgtgctaccacttttattacctcttttcggttatatatctatcaatgtgatgaactgtcagagccgttatttccggtgtttcctgacgatgtgctgcccgatgaaccacctgtgccggtgtcgcctgatgttgtatcgcctgttgttgagcccgaggctgttcctgtaccatcagttcccgttgtgccgcctccgtcaccttcccttccgataactatctgaacctttatctcgtcccatgtgtacttggtctcatccagatttggctttaccgtcactgtatgtgtacctgtaccaaggcctgtcacatcaattttacccttcagtgtagttcccgaaagtgtatctatatcagacttggtgccgcttactatgacactactcttatctgttacaaatgtaagcgtatatccatcttccagtccgtcatatgtgatattggagctgttcagcgtcatggttgaagtcgcatttgtttcaatctttatatctatactgagctttgccttggatgagttcactataaaaactccatccggcagatatcctgtcaggtcaacagatgtacttatatcgtctgttgcacccgatatatcgattgggcccacatctatagatgtgatattgttcaatgcttctgcattacccttgagcattacagactcctctgatagttctactccgagcacgctctttcctcctgccggcgagcctgtcgtagtacacttgataggcacctccttggtacttaggacatcaactgtcactgctatagactgatactggctgtccacatcaagctttgatatatctatctcatcgccattatcatcaatcagagtgagatcaccgcgatcagttatctgattatctgatattatggtattgtcatcgacctttatatttacattggccgatgctatagttgaaacaatggactcaggccctccgatctttactacctttggatttgcctgtggcttgtttcccagtgctttcgcacctgagagacttccatccaatgatacctttacctcaaactgcttctgcatatatttttcaaccgaaagcgggagcatatggtctccaccgttgaaggtaatcgaatgtctgtacttggtgcatccaatatctacctttacgcttgccttattcgtatcatccttatctactatgatatttgcaaggtcgacatttgcgtaaaaatcagaatcatcaagctcgttcagatagcttctcttgcctgataccgaaaagctgatggtcttttccgaatccttgatggtaggccatagccccttgtcaacaaccgaatcacggcctgtgacggtgactgttgtggtaaatgtctttgtcttgaccgggtcattgagattgtagaccacaagccagagtataaatgcaaatgctatcgcaagtattttaaagcctatattatttgtgaaggtttttagaagcttctttcccattcttaaacctccttttaattaattcaaatttacccggctccctatgtctgttctgcagaagcttaagctgtgtgcgtagatgatcggcatctatatcgtgctcaatctgccccttgtatgctgtagaaactgatcctgtctcctctgaaactatgatagtaagcgaatcacttacctcgctgactccgaccgctgcacggtgtctggttcccaaatccttcgagagtgacaggctgtctgatagcggaaggtaacatgtagctgacaccacacggttgccacgcacgataaccgctccgtcatgaagcggtgtgtttttctcaaaaatattgatgaggagctgacttgtaagtatagcatccacatctattcctgttctgatatactctcccagatttatctcatcctccatgactattagcgctcctgtctttactctgcccatcgcaaagcatgcacgcaccagctcatcaattgtcttgtcggagaatttctcaatttcgcctctgccggtattaaaaaaatcacccaaaaaggtctttccaccaatattctccaaggcatttcgaagctcaggctgaaaaataacaacaagtgccacgagacctatattaaagagtttctcagcaagccacagtattgtatccatctggaacaatgctgcaacaagcacaaacaacagtatgataataaggcccttgaacagattccatgccctcgtggtctttatccacaaaagtatatgatagaagagcactgaaataataagcatctctataatgtctatcacaccgattttgatgcccggcacatttgtgaatgtaaggaactgatccttgaagcgtatcaatacaccactcacattatccatagcgccctcctttctcttatactatgtaactatttgtcatcctcaaatatattttcgtctatttcgagatcttttgcaatagcctctttgctgatattttcctgattatgtctctgaatcttctttccaaggcttcctgtattgccaaagtgctttacaaccttttcctccttggcaatcatcttctttggaactgccttgacgtaataataatattcatcatcctcaaactgtacattttctgtacgtgcatagtcaagattcataaatataaactgtatgacaacacctgcaaaaatagctgctacagtgctgagcacaagccagattatcttctccggcagtccgagcaccagataagcaacaacaagtgcaaccaactgtacgagtcctcctgctatggtagcaacagtccatgaattgttgattttcaatcgtctgacctgatacaccaccagtgtggtgataacaaagattgccataactataaacatctctttgttgtcaagaagctgtcccattgtcacattgagctttgtagtgctctgcccctttttatctaccacctctgcaagcgctgatgcattctgtctgattccgtcaaggaaatagtacaacagtgtgccacatattattgcaacaaccgaataagctcttcttaaaagacctgctgcaaccggcataacagatggtatgtgaagctgaaagcatataggtgtgagtatcacaagcatgccatccttcggtgcaaaacgaaaatagacaaaatacagtactaaaaaaagtacaaatgtgatagcaaaaacctctatggacagcgcatacatatctaaaagtatcataatcgaagcaatccagagtattgcattcaccggaagcagtgcacacacaagcgctaaaagcagtgccacaagcatcgagctgattttcgccatatagccgatattcaaatctattgttataaatgcgataaatgcaacggcaaatctcacaaccggaagtataaagtgctcatactcaccgcaaaatttgactgccttatccttaatttccagtaacttgttcataaagcctccctaacgcttaatcttttcctcacgggaatatattctgcccactgccttcaggtgatttgcgtatttgcgcacttctcttctgccggccttatatcttgcagtatacaccacaattgtgacaaaaatgtaaaccgccataaatgcaatatacagtatgcctattgtgacacccattgccttaaaatcaagcttattgattctgtccaaaagctctgctgcattgacagcaacccacatcacaacaagccctgcaaatgcgaatgtacctgtaaagaagctttttaagccctctttccatatatagtcccatccgtaatagcttgcggactgcttctgcacacggctgtcatcgcttttgctgtcacatagagcaatattaaacagttcccttactttttcttcgtttatcataaatcatcctcttacctgttacttgatatatctcatacggtttttgtcatcctgctgccacagctgcctatcctggctctttggtgtgtcaagggcactgcgtagtgtgtttgtgagcttagtcttgcactcatcacaaaatctacctgtacgtatcatccttccacagttctcgcatggtataccatatgatgaatccggtgaaaacgaaagcctttcctcacgtatccacctatttatctgcttcatggatgtatccgtctccttggccactgtctcaaccggcacatttggattatcctcaacaaatctctttactatatcaaatttctcatccatttttttctggcagttcgggcagtactgctcatctgacagtacattaaatattctgccacagcccttgcaattagatattctcatctgataaaaccctcctaacttccctgtcctatgcaaatacacagcacatatacacgaccgggacatttctttgctatctcgtgcccaatcgactccgccgtactgcctgtagtatatatatcatctactattagtatttggtcatattgtacaatactatccgccacttgaaaagccccctcgagacaatttcttcgttcaacataccccattgtcttgagtggactggtatttttcactctgcgcacaagcccttttgccatccttatgcctgttttttcagacaatgcccttgcaaaacactctgcctgattgtagcctctctggcgcatctttttacggtgcatcggcaccggaataataacatctatcccacatctctgtatccagtccgaatatctttccactgctgtctgtgcaaaataagccgcatactcacgtctgtttgaatacttgaacctgtacatggtctgctttatgctgcccttgtatgcaaaaagcgccttgccctgcctgtagctgtcatcttcccgcatctgcctgtgatgctctagtgcccgtgcacagtcgtcacaatactctcttcgctcagacaaaaccggcttcccgcagcgcatacattgcggctgctcaaccggaaagagcttttcacagcatctgctgtgtatatatctctcaaccggaccaattataccatcacataccggacagcgcggtggaaataccagattgattacgcctctcccaatatcctttattttgttcactaatccccctgactgtaatatccccatttgtaacattattaacaaaaaagcgacaatacattcctgcaatgcagggacatatcatcgccctcacggctgcctgttataaaacgtatattctagaattcttcatctctcttgcctgcaaggaactctacatactttcctgtaccgatagcaacacatgtcataggctgctctgcagtcattgtattgatgccggtcttttcctcgataagctcctcaagacctctgagcagcgaaccgcctcctgtaagcacgattcctctgtctgcgacatcggctgcaagctccggtggagtcttttcaagcactgagtgcactgcctcaactatctgaagagttgcctcacgaagtgcttcctctgtctcctctgagctgactgtaatagtccttggaagtcctgttacaaggtttcttcctcttacctcaattgtctccggctgtgggagagggtagcatgtaccaatcttgattttgatatcctcagctgttctctctccgatgagaaggttatgcttctttctcatgtatctgacaattgcctcatcaaaatcatctccggctatcttgatagatgtgctgactaccgaaccaccgagtgagataactgctatatctgatgtaccaccaccgatatctactatcatatttccgcatggctttgaaatatcaatacctgcaccgattgcagctgcgattggctcctcgataatcttaacatctctggctccagctgcaaatgtagcatcctcaacggccttcttctcaacctctgtaacaccacttggcacacatacgctcacgagcggctttctgaagctcttcttaccaagcgccttctggatgaagtgcttgatcatcttctctgtaactgtataatctgagataacaccctgacgcaacggtctgactgcaacgatattacccggtgtccttccgagcatgaggcgtgcttcctctccgattgccttaatcttgttggtgtccctgtcaaaggctactactgaaggctcctttaacacaacaccctttccttttatataaacaagtatacttgctgttcctaaatcgattccgatatctgatccgaccattttaatagcccctttcctgccatatctttaaatttacacatacactctcttattatatacaataaatcccatttttcaaactttttttttgaaaaagatcatatttaataaaattttaaagtttatccttgtctttttccagatatggtttcaaaaaccggcctgtatatgactgttttacctcgcatatctcctcaggtgtgccctgcgctatgacggttccgccgccgtctccgccctcaggtcccatatctatgatatagtcagctgtctttatcacgtcgaggttgtgctcgataacaactacagtattgcctccgtccgagagcctgcgcagtatctccacaagcttgtgtacatctgcaaagtgcagtcccgtggtaggctcatcaagtatatatatggtctttccggtgctctttctgctaagctctgtggcaagcttgatacgctgtgcctcaccaccagaaagctctgtggacggctgtcccagcttcacataggatagtccgacatcatagagcgactggattttgttctggatttttggcacatttttgaaaaactcaagtgcctcctccactgtcatatcaagaacatcgtatatgctcttgcccttgtactttacatcaagtgtctccctgttatatcgcttgcctccacagacctcacacggcacatatacatcaggcaggaaatgcatctctatcttaaggattccatcgccgccgcaggcctcacaccgaccgccctttacattgaaactgaaacggccctttttatagccctttgccttggcatcgggtgttgatgcaaacaggtctcttatcatatcaaacacgcctgtatatgtggcaggattagagcggggtgtacggcctatcggtgactggtcgatgtctatgaccttgtcaagctgttcaagaccatctataccatcgtggtcacctgcgatacacctggctctgtttaaggatttggccagatgcttgtagagtatctcattggtcaatgagctctttcccgagcccgacacgcctgtaacacaggtcatgataccaagaggtatctgcacatcaatatttttcaggttattctccctggctcctcttatcgtgatatatccgcttggcttgcgcctctcctttggcaccggtatctttattttaccgctcagatatgctcctgtgagagattttttgcactttatgatgtcttttaatgagcctgctgccactatctccccgccgtgcgagccggctcccggccctacatccacgatataatccgctgcacgcatggtatcctcatcatgctccacaactatgagcgtatttcccagattcttaagattcataagtgcaccaagcagcttgtcgttatccctctgatgcaatccgatacttggctcatcaagtatatatgccacacctacaagtcctgagcctatctgcgtggcaagcctgattcgctgggcttcccctcctgaaaggcttgccgtgccacgggtaagggtgaggtaatcaaggccgacctgctgcaaaaagccaactctcgcacggatttcctttagtatctgatctcctatatagtgctgctgctctgtaagctctatatcagcaaggaacttcacaagctccttcacagacatggaggtcatctcatatatgttcttgtccgcaaccgtaacggcaagtgacgacggcttaagcctctgccccttacagctcgtacacggagtaatgcgcataaactgctcatactctgcctttgccgtatcagaaaaggtctccttgtatcggcgctcaacattgtccacaaggccgttccatacaaggtcatagacgccttcgcccctctgacccttgtatctgaccttgagcactctgccatctccaccgtaaaaaagcagttttttcatatctgcagataaatcatcaatcggtgtgtcgagaggaagcccatagccctcatgaagcgcacgaagtgtcgcataggtatagctctttgggtctgtacatgactgccagcccatcacctgtatggcaccctcagatatggaaagcgatgcatccggcaccataagctgcgggtcaaactccatcttgtagccgagtccgtagcaggtcggacatgctccgaacggattgttgaaggagaagcttctcggctcaacctcatctatgcttatgccacagtcagggcacgcaaagttctgggaaaaggtcatctgctcgccatccacaatatcaactatggcattgccctctgtcagttcaaatacattttcaagtgaatcagtaagcctcttctctatgcccggctttacaaccaaacggtctacaacaatatcaatattgtgctttatatttttctccattgggatatcctcggagagctcatacatgctgccatctacaatcacacgcacatatccgctctttttggctctctcgaacagcttctggtgctcacccttgcggcctcggaccaccggtgcaagaagctggatacgggtgcgttcaggcaacgccataacagtatccaccatctggtctatcgtctgctttgtaatggcgcgcccgcacttcggacagtgtggtattccaattcttgcataaagcagtctgaagtaatcatatatctctgtgaccgttccgacagttgaacgtgggttcttgttggtggatttctggtcaatggaaatagcaggcggaagtccctctatagactccacattcggcttctccatctgtcctaaaaactgacgtgcatacgatgaaagtgactccatgtacctgcgctgcccctcagcatatatggtatcaaatgccagtgatgacttgccggagcctgaaagccctgtaaaaacaacaaactcatctctcgggatgtcaagactgacgcactttagattgtgttcgctggcacctcgtattttgatgtattttctttctttttttgccataatttgtgttcctccaaattgcttccaaatatcataagcttttatcgtatatccctcagtgtgtttttcagcataataagcttatccctgtactctgcagcagcctcgaaattgagctctgccgctgcttttttcatctttttctctatatctgcaatatgcttctcaagctcttttttgctcattgactccggatctttgtcaagagcattctcatcggccgctaccttctttgagatagctatgagatcacgcacggatttctgtatagtctgtggcgtgatgccgtgagcctcattgtactcttcctgtacctttctacgacgctttgtctcgtcaattgcgacacgcatggagtctgtaatcttgtcagcgtacatgataacatggccctcactgttacgtgcggcacgtcctattgtctggataagtgaggtctctgagcgaaggaagccttccttatccgcatcgagtatggcaacaagtgtaatctccgggatatcaaggccctccctgagcagattgatgccgacgagcacgtcaaatacgtcaagacgcaggtcacgtattatctccgctctctcaagtgtatctatatctgaatgcagatactttaccctgatgccaagctctgccatatagtttgtgagatcctcagccatacgctttgtgagtgtggtgataagcaccttgtgatggtttgcagtctccttattgacctctgatacaaggtcatcaatctgtccctcaacagggcgcactgatatctcaggatccaaaagtcctgtcggtctgataatctgctccgcacgaagcagctcatgctcattctcatacttattcggagtggctgagacaaagagcatctggtctattttaccctcgaactcctcgaaatttagaggtctgttgtcaagggccgagggcagtctgaagccatagtcaacaagagtggtctttctggagcggtcacccgcatacataccgcctatctgcggaatcgtgatatgtgactcatccacgattatgagaaaatcatccgggaagaaatctatgagtgtcataggaggctcccccggctttgcaaagttcagatgccttgtatagttctcaattcctgagcagaaacctgtctccctcatcatctctatgtcaaaattggtcctctctgctattcgctgagcctctatgagcttgtcctcgcctttaaaatacttcacacgctcatcaagctctttctctatattgaggcaggcctcatttatcttctcctgcgaaactacataatgggatgcagggaaaatcatcgtgtgctcaagcgagcactttacctcgccggtcagcacatcaacctccactatccgatctatctcatcaccgaaaaactcaaccctgattgccgtatcatcggcatttgccggaaatatatcaagcacatcaccatgcactctgaaggtgcctcggtgaaaatccatatcattcctggtgtactgtaaatctatgagagccctcgcgagatcatccctgtccctctcctgccccgggcgcagcgaaatactcatgcctgtccactcatcaggacttccaagtccgtatatgcaggaaaccgatgccacgacaatgacgtcctttcgctccgtgagtgctgccgtggctgaaagcctgagcttatctatctcatcatttacagaggaatccttggctatgtacgtatcagactgcggcacataggcctcaggctggtaatagtcgtagtaggagacaaagtactctactgcattttcggggaaaaattccttaaattcagagtacaattgtcctgcgagggtcttattatgacttatgataagtgtcggcttattaagagctgcaatgacattagccatggtaaaggtcttgccggagcctgtaactccaagtaaggtttcaaactggttgccctccttaaagccctttacaagctgctctatcgcctgcggctggtcaccggtcggcttgtattttgaatgcagtttaaattccataacgcacgcttcctccaaaaaaatcttaaatactgcttttgtaaaattataaaaagacaaagtcaatcatttatagtatgcacttacgcgcattattttactacaaaaaatcgactttgtccacaattttcagaacattcgttcttgtttatttattttatgttactgttcacacctaacagtgtgaccagcaacgattacagccatttaaaatttacttcacacgtccacagcactgcttatatttcttgccactgccacatggacatgggtcattcggatataccttggctgctgcacggcgctttggtgcattctgtgctgactcatccttgtttgtgcccgaaatctttgcaacctgctctcgctcaaccttctgctcaacctgtacatgatacagcagtctgacagtatcctcctggatagctgaaatcatgtcgtcaaacatatcaaagcctgccatcttgtactctacgattggatctttctgtccataagcctgtaagccgattccctgacgaagctgtgccatatcatcgatgtgatccatccactttctgtcgattacacgaagaagcacgacacgctcaatctctctgaactgctcaggctcagggaattctgtctccttctgctcataaagcatgacagccttttcctttaagtactgcttaagctgctttgcattcttaattgactcaatatcctcttttgtaatcggatcaagcggaatgaccggaagcacaagctcgttgagctctacaagatcccagtcagctctgtcaatttcctcggaaatacatctgtcgacagacttctcaacctgctcctgaaccatcttaaggatagcatcacgcatgttgtcaccgttaagcaccttcatacgctcgctgtagataatctctctctggtcattgtccacctggtcatactcgagaagatttttacgaataccaaagttgttggcctcgattttctcctgagccttctcgatagcagatgtgagcatcttatgctggatctgctcgccctccggtactccgagcgcattgaaaacgcccatcagacgctctgaaccgaaaagtctcatgaggtcgtcctcaagtgagatgaagaactgtgactcaccaggatctccctgacgtccggcacgtccacggagctgattgtctatacgtcttgactcatggcgttctgtaccgataatcttaagacctccggcagcctttgcctcatcgtcaagcttaatatcggtaccacggcctgccatgttggttgctattgtaactgcaccatgctgtcctgcaagtgcaacaatctctgcctctttctcatggaacttggcatttaatactgtgtgagggattccctctctcttgagcatgccgctcaaaagctctgatgtctcgatggtgattgtacctacaagaacaggctgtcccttttcatgtgcctctttaaccgcatccacaactgccttgaacttttcctttttggtagcgtatacagcatcctgcaaatcaatacgcgctaccggcttatttgtaggtatctcgacaacatccatgccatatatatcacggaactctttttcctctgtgagagctgtacctgtcataccggccttcttgtcaaacttattgaagaagttctggaatgtgattgtggcaagcgtcttgctctctctcttaacctttacatgctcctttgcctcgatagcctgatgcagtccgtccgaataacgacgacccggcatgatacgtccggtaaactcatctacaataagtacctcatcatcctttaccacatagtcctgatctttgaacatgaggttgtgcgcacgaagcgcaagtatgatattgtgctggatttcaagattctccggatctgcaaggttctcgatatggaagaactgttctacctttttcacaccatcctgtgtaaggtttacaaccttgtccttctcatttacgatgaaatcaccggtctcgtcctggacaatgcccatgatggcatccatctttgaatactcaggaacatcctcaccacgcttcatctgtgtagccaggatatcgcatgcctcgtaaagtcttgtcgacttgccactctgtcctgaaatgataagaggtgtacgtgcctcatcgataagcactgaatcgacctcatcgatgatagcatagtggagacctctctgaacaagctgttccttgtagataaccatattgtcacgcaggtaatcaaatccaagctcattgtttgtgatatatgtaatatcacagccataagcctccctgcgctcgtcattgtccataccgccaagtaccacgccgaccttaagtcctaagaactcatgaacctgtcccatccactcagcatcacgctttgcaaggtaatcattgactgtgacaatacacacacccttgccctcaagtgcattaaggtatgcaggaagtgtagaaacaagtgtcttaccttcaccggttcgcatctctgcaatacgtccctgatgcaaaataataccaccgattatctgtactctataatgttccatgccaagcacacgcttagcagcctctcttactgtagcaaatgcctccggaagaatatcatcaagtgttgctccgtcctccagacgctttttaaactcccttgtcttatcctttaattcttcatcggaaagctttcccattgcttccttatatgactcaaccttgtcagcaatcgggtaaattctcttaagctctctctcgctgtgagaaccaaagatttttgaaaatgcgctcatatttttctcctataacttcaaattgcccttgtacaggctcacaatagtgttattgtaacactttgaggatgattgcacaacctaaagggatgaatgttttgtaaacattttataaaaatattgatgtttgcgcctttatttttttttgggggcttcgcgcgagaaggctgtgcggtccggggtagcacacagtatattcctcataaaaaatatgaagtcagccacggctttttgccctgacaggctgtgttttggtgatagtgcttcatgctatttgagtttatggaacaccgtggcagttcatattttttattctgaacacactgtgtacttcccggatccactttgttgtgcgcgaagcatggcagaattatttttttaattcaaaagctctccttatgggagagcttttggagctacatgtttatatacggaagctattttactagttatttcattacttttgggcttcatatgcctcgcggcatgcttttgcgagctggtcgccgcaggatgtattcttaaatccacatttaattccaccgattttttcctctacctgggcaactgtgagtccttcaacgagctttgggatggccttaagatttccgttgcagcctcctgtaaactttacgttatgtactacatctccatcgaggtcaagctcaatctgtgttgaacaggttccttttgttttgtaaatatatgacatattttatcctcctgtgttttcagtttttttgtgtatacatgattataacatatatttttacatctttactatgttttttcacattttccaactcagtttttcaattcagaagttactgttcacacataacagtgtgaccagcaatgattcagattcataaatcttttcctattatttatttactatttacgccataacgtaagggacgattcgcgcgggcaccgcggtgggctgcatacactccggagtccgcgaatagcgaagctgcttagatactgtcgaattatgcacatgctacacagaaatgccgaggcatggagaaatcgagccatggatggcgagtttcgacgttttcgtcatcctatgaaaacctacaaagcataatttgcacagtatcttggctgcgcagcgtagcggacaccggagtgtatgcagcccaccgcggtgcccgcgtgaatcgtcccgtactataatctcaataaagtaatattcccactctagaggattaccggctggatctgtcgtccggccatcacttcatttattgtgtcgacaacctgttttccatcgcacacgagtgaattcggtttcttcacacagtcatcctgcccaaacggcacaaaataaatatttttcatattcatcagctttccgatattcttaaagttgatgccgagcgcatcatttgtggaaatcccgataacaagcggtctgccgtttctcagatgagcctttgccgcgagaaggaccggtgtatccactatgccgtttgcaagctttgccgctgtgttgccggtgcatgggtaaatcaccatcacgtcaaacagttttcccgggccgacacgctctgcctcctgcagtgtcctgatgccctcatcccctgtgatttcggagatagtatgcataaagtctcccgcctttccaaagcgtgtgttcatcatctgtgcattataggaatatacaggtgtcacatgtgtgaagctatccacaagcctctttgcaacatccttagtcttttcaaaactacaaaaggagcctgtaattcccattcctacggtgcaatccgaaataaccataagccctccgtcataccttttcttttcatacagtcataaagtatttttgcaccggttttcggacagtatatgcccggaaggccgagcgcatgcgtacagtttatctgatacctcttacaagcctcaaaatcacagccgccgggcttagatgcaatatctataattattgcatctttttgcaaaatcatgattaaactttcatctataaccctatccggtactgtgtttatgagaaacagtgtttcaaaacatgccttggcaggatcattaaaatccaccgtttcatatcccagttcagcggcctcatgccttgcctgttttctccttgccatcaccatgacatgggctcccatagcagaaaaaacgcgggcaattgcctttccgcattttccaaacccgctcacaagtacctttgagccgtatataccatgtatgcttttttgtattgctatggacgcagtggcctcggccgtaacaatggcattctgctctatgacagtttcatctctcataaagtcacagcccctgtcaacgccgggaaagcactccggcatcatgccgccccacactgcaatattgttaattattatattatgttttaatttttctatatcactatttataagctttagctttgaaaaaggtgtaggaaacacaatattcccaacacgctcataatcaatcccgccgctatttctgcaatctgtctgttctcctcccagcatatcagcgaggtacttttgcctctgatccgtaacatatattatagtgtctttttgcataataacttcttcctttcgctataatatatgcgcatttttaccggatgtgagggtatttcgtttttatcatttagagcatcctcataaagctttttcaaagtttcacttattcaaaaaatacagagcttgtcatatattaatattacgacaagctctgtatttttaatgccaattgaattctaactgattttcattttattcaattcgattttattttataaattctacatttaatttttaaattatcctattcaattccggttccaacggataatctctccgtagcttattacagctgtgtgacaacaaaaatatcgtagatggcttttattgccttgtcaaagtcatcattgcttacaccgatgatgatattgagctctgatgaaccctgatcaatcatgcgcacattgatattggcatgtgcaagtgcagagaaaatcctgccggctgtaccacggtttgacttcatgccacggccaacaacagcgataagcgcgaggtctgactcgaggtcaatgatatcaggatgagcaagtcttctgattgagctgataacctgctgctccttgccctcaaactctgcctgatgtacgaatactgtcatagtatcgatacctgatggcatatgctctatagagataccgttctcctcaaacgcctggagagcctttctacagaagcccacctctgagttcatcttgtccttgtcgatatttaccgcaacaaagcccttctttccggcgatacctgtgatggtataatcaggcttttggcatgtgctctcaacgatgagagtaccaggtgcttccgggtcgtttgtatttctgatattgattgggatgcctgcctttcttacagggaaaacagcatcctcgtggagcactgatgctcccatatatgaaagctctctgagctctctataagtaacaaccttgattggctgtggattgtcgataattctaggatcagctacgagacagcctgaaacatctgtccagttctcgtacatgctggcatgacatgcctttgacacgatggaaccagtgatatccgaaccacctcttgagaaggtgactacctttccatcaggtcctgctccgtaaaagcccggaataacagccttttctgtctgctcaagcttctttgagagcaccttgtctgtcttttccgcgtcaaaattgccattctcatcaaaaaagatgactgttgccgaatctataaactcatatccgagatagtttgccatgatgattccgtttaagtactcaccacgagaggctgcataatctgcacctgcctttgccttgaaattctcagcgataatcttgaactcctcatcaagtgccagctttaaatgaaggccatttatgattgaatcatatctgtccttgatttttctgagcataaccttgaaatcctgatcattctcagccagatcatagcatgcataaagcatatctgttacctttgtgtctttggaatttctctttcccggtgcactcggcacaacatattttcttgactcatcgcttcttacgatgtcgccaacctttgtgaactgctctgcactggcgagcgagctgccgccaaactttactacctttaccatttgtctgtttttcctctgcttcctatataaataactgtattagccaatattataccgctttgataaatcattcgtcaatactcaatataatcaacatcaagcttcataacatcatgttctttgtcaaatgtgatgataccgtatgatggcatgcagccccacagcggtgcaccgatgcttccaggattcatcatcgcaagaccattgtgcttatcataaaacagcttgtgtgtatggccaaagagagccagatctgccccgatttccttcgcatgaagctccagatgcatatatgacagctttactccatatgtatgtccatggcacatgagtaccttatagccgtcgatatcaataagtctctctgtatctccccgtgaaaaatcacagtttcccggcacattgaccatggttatatgaggaaactctctcctaagggcatccgcatccacaacgcagtctcccagatgaagtatcatatcaggctcctctcttttgactgcccgaatcatatttcccacattaccatgtgaatcactcagtaccaaaactctcttcatgcgcgtctctcctatatcttgttttacgtatccatccagagccaccttgagaacaagaaaatctgccgcttacatgcgagcatgacgcatcagctttttttgttctcaatggttctgaatagttaccttttttatatattatcataagttttccgcgtgtaaaatatttttttctttatatacgcaaaaaagctccatgccgacttcattgtcagcccggagcttttaatctttaattttaactatgcaagcctcttccactgcttgctgcacttataataagaatagaacatacatctttctgcctgctcgcatctgactggtgcactctcgatattgcactggcaatttacaatagcatctgcttttcccttacatgaacccttaatcattacatcgtctaaaacttcgtctgacattctctttctcctcacatttgtttgatagtatatttacctgttacaatattgatatattttattatttttctctgtacgggctatgctttacgtactcttaccatcggcttaaatactaacatcttgtccgcaacagttgtgattatactatatattgtattttaaatccatatgtcatttctaacaaaacaaatgattttttatgtcacatttttcacttgacgaatttcattttcatgttcaagcccaaaaatcaaggatatctgagtaaaacttctccaaggtatcatcatccgcattaaatatctcgtgctttgaatcaggatagaccttcttaatgccctgaggcagtttcgcaataaattcatcctcagcggcatttgaaaccagataatcctttcccgcctggcataacagcaccggtattttaatttcctgtgcatgcttctttatatatttggatgccttgcgcccggccctgcaccatctgtaggtggcgccatttgtacgatagcgttcctcctccaccttgcacttgtatatgtagtcatagcgcgcctttgacagacaacagctcgattcaaaatcatactcatccgtatacggtgtctggctcggcagatatttatcgttccagttaagcacacttgcgacaaacagtatcgcctccacggcaaaatgtgaaaaattgccataaagcatctctatcatagggcttgaaagtactgcctttgtaaatacctcaggatgcttctcaagatacagggcagctatcgcgcctcccatagagtgaccgtacaagtaaagcggtctgcgcccctcacgcttcatcacaatctcgcggataaacatatcaaggtcactcacataatcgtcaaagctgtttacagtgaccatgcttatatcggatacacttctgtccgaaaagccgtgtcctcgatgctccaccatatatactgagtatccggcctttgcgaaatagtaaatcatctcataatatttaggcatacactctgtaaatccatgtgatatgactatggcagcctttgctacaggtgtcgtcacatagccgtaatgtatgcgtgtgccatctgcactcttcatatagccatcttcaaaattaagcctgataaaaggcaaaacatatcttgttaattcctcattatatttttcttctgtaataatcatagcattcctcacttttggtatttgatattttgtaagtaactatatctcaatccggtcaataagattcaggtcatattttctgactatatcaagtgccttttcatagctttccacatcacatatattgtccactgtatgtgcatcaagccccagtatcactttgttgccgatgtcatgcggtatacaccagaagcgctctgtcggatagtgctttcctgcactgataccaagcatgtttatctcaagcggtatgtcaagctccttaagtgccttgcacatcctcgtcatctcccattcgtagacggaatcaagtccctgataatttattaaatcaggatgtgctaaatagctgtacatgcctgttttcatgccctctataacagtatccacatactcgcgtatacggctctcatcatctgtcggtgtgcctgtatacggacctgtctgctctgatttcataaaatgctggcccattatcatgtaatcacagccaagcctgtcaaacatagccttctgctccttgaaaaactccggtatgtactccgcctcaaagccaacgtagagctttatgtcggatgcatactccttcccaagctccctgatggcatacacatactccggtgcctgctccatcgtcatccggatgcccgacacatagccatccttaaaggggcacggcacatggtctgaaaaacctagctctgcgatacccattctgatagccgcctctatatattcgcgctcgctgccatatgcatgctggcacctataggtgtgcgtatggtagtttgcctttaaaaatcccgtcatttcttaaagctccaaaaatctatctcttattgctgttcaaacagctattcaaatactacaattaaaatcaattttatcactttttgcactttattacaatctcatatttttgggacttttttctctatgaaatatatatgcgttatgttataatccattgatatatgatagtcataataattctatccaccacacaatcataaatgaggggcaaaataccttttgatcctcatatcattatatttttatatacggaggaaataatgttcaaaaaaggagtggttccctcccagggactgagaattatcatcgtcggatgcggcaaggtaggccgtactctcgttgagcagcttggcaaggaggggcacgacataacaattgtcgacaaaaacagggagaggatttcccaggtatccaatatctatgatgtaatgggtattgcaggaaacggtgccagctacaagatactgcaggaagcgggtattgatgatgccgacttaatcatcgcagtcacaggctctgatgagctgaatctgctatgctgtaccattgccacacaggtcggcaactgtgctgctatagccagagtcagaacgcctgaatacagccaggaggccaaatatctgcgcgacaagcttggtcttgcactcattatcaaccctgagcttgaggcagctattgagatggctcatattcttcatctgccgtccagccttgaggtaacaaactttgctcacggtcaggcacagctcatcaagtatgagattcccgagggcagcatcctcgacggaacaaagctcatggatctgggcaccagacaccatgccaacatacttatcggtgcagtcgagagagatgatgaggtcactatcccatcaggtgattttgtgctccgcaagggcgacaagctgtcatttgtcggcgaacgcagacatacaaaggaatttttcagccacatcggagtcaatacacacagcgtaaaaaatacactgattatcggaggcggcaaagccgcatattacctggcaaagcagctcatatcacgaggcataaaggtcaaaataatcgaaaatagcttcgagcgctgtgaggagctttccatactgcttccggatgctgtcatcataaacggtgacggaacagaacaggcactcttaaaggaagagggcatagagacctgccagtcatttgtacctcttaccggtatagacgaggaaaacatcatgcttacgctctatgcgaagcaggtttccaatgcaaaggtcataacaaagcttaatcgtataacttttaccaatgtcataaacagcctagaccttggcagtgtaatctcaccaaaatacatcacctcagaagccataattgcctatgtccgtgcaaagaaaaactctatgaactgcaatatagagactctctaccacatgtacgactcaagagttgaagcaattgagttctttgtatcagaaaactcaaatgtgacagacataccgcttcgagacctaaagctcaaaaagcatctgctcatctgcttcatcaaccgaaacggcaaaattattatacctacaggtaatgactgcatacaaaaaaatgatactgtcatgattataacaacccataccggctttacaaatcttcaggatattatggaatagtgggggaatgatatgaacacttcagtaattcgatatcttttgggatatattttaaagcttgaaggctttttgctgcttctgccatgtattgttgccggtatttattatgaaaaaagcggcatctactttttgattgttgcactcataagcatagctatcggttttattttttcagctaaaaaaccgagggattttaccttttacctgaaggagggctgtgcaacaaccgcactgggctggattgtactgagtatattcggctgtctgccgttttacatatcaggagagattccaagcttcacagatgctctttttgagaccatctccggcttcaccacgacaggagcgagcatcctgcctgaggtagaatcactctcatattgcatgaatttctggcgctgctttacgcactggattggcggtatgggtgtgcttgtttttcttctggcaatcatcccgctttcaggcggcagcaatatcaacctgatgcgcgcagaaagccccgggccttcagttggaaagctcgttccaaagatgaagcataccgccaggcttttatacataatatactttggtcttacgactatggagattattttcctgcttttcgggaaaatgcctctttacgatgccatctgtacctctcttggcacagccggaacaggaggctttggtatcaaaaacgacagcttttgcggctacaatgtttatctgcagtgggttgttaccatatttatgatacttttcggtgtcaatttcaacgcttactacctgcttttcttcggtcacatccgtgacgcacttaaggttgaggaggtcagatactatttcggcatcataatagcctccgttgtagtcataagcgtgaatatcgcgcatatgtgtaccggtgtgtttgacgcagtcacaaaggcagcgtttcaggttggctcaatcatcacgacaaccggattttccagcaccgatttcgacagatggcctgagctttcaaagacactgcttgtgcttttgatgttcattggtgcatgtgccggaagcaccggcggcggtatcaaggtatctcgtattgtcatcgctgtaaagacaatacttaaggagttaaatggctacattcacccaaagagtgtgaaaaagctcacctttgagcacaagcctgtagaccatgatgttatcaggtcaataaatgtttatttcatgacgtatgccgtcatttttgttgtttcaatgctgcttgtttccgttgaaaactatgatttcactaccaatttcacggctgtcgcagctacatttaacaatatcggaccgggtctttctctggtcggtccgacatgcaatttcggcttttttaataatttctccaaatatatactgatgtttgacatgcttgccggaagactcgagctgtttccactgctcatcctcttccatccgtcaatctggaaggaattatttattcaagcagataaaaaagtaaaagggaatagaaaggagaaacaaaatgttcgcatgtaaaaattgcggtggaaatgtgaagtttgacatcaaatcaggccagttagcctgtgaatactgtcattcacttttcgacccttacgcgtacgaggacaaaacctctgacgccgaggtccagaaggacttcgaagcaaccattttcacatgccctcagtgcggaggagaaatcctgagcacagacgataccgcagcaggcttctgcagcttctgcggtgcatcaactgtgctctacagccgcatgcaaaaggagcacaagccggcttatatcataccatttgcaaagagcaaggatgactgtaagcaggcctacatgagcctcatgaaaaaggctattttcgtgccaaaggagcttaaggatcctaagtttatcgatggattcagaggtatctacatgccttactggacatattatattacccagaaggctcctatttcacttccggcgaaaagatcccaccgttcaggagattacatcattacagaccatttcaggctcgagggagatctcgacgcctactacaaaggcctgtcctacgatgcatcatcatcctttgatgacagcatcagcgaaaaactcgcgccttatgatgtgaagaatatgaagcgctttacaccggcattcttaagtggtttttacgctgatacagctgatttaccatcaacggtttacgcaagcgacgcaatggatgcagcctgcacaaacacagtaagcgaaataagtaaagagcctgcctttaccggcttgtcagtcgacagtgactccgctgctctttcgcctttaagtcttggcactactgtaaaagaaacagattactcgatgtttccggtatggtttttgtcataccgcaataaggatcgtgtggcatatgccacagtaaacggccagacaggcaaggttgttgcagatctgcctatatctgtcggtaaattcctgctaggctcactcattgcggcaattccggtatacattttattatgtctgctgacggttctcactcccggaatgactctcaccatagtcggtgtgcttgcgattatcgcaaatatctgttactcacaggagctgaccatgattgctgtaaaggaagccggtaccgaggataagggccgtatcgcaaaggaacagccggaggcacttggtacaatcaacaaccgcagacgccttaaggctgcaaaaaaggccacgaaaaccataaagaaaaagacaaacacatcgtttgtagcttactttatactttttatatttgtcattcaatttgttcctgctctgttttcaatcattgcaggtatcggaggtagctttggcaatgcagacggcagcctgattttatttattattttgaccattatatcattcattttttcaatcagagccttctcaagctttgaccggatgcccggacacaagggagttgccggactcatctttggcatggtatccatgcttattggcgatgctgttcttttgttccagccggtgctcgatgcatggtactatggcgcagcttttatcatcatcgcctcagtgcttatcacactgattaatgtcatccgcgcattcaacgtgcttacaacgcgcaagctgccacagtttgccacacataagggaggtgatgaccgtgcatagaaataattataaaagtccttttttgcattgtataaaatgcaggtgttcagctttgtttacattatttttgcttgttacagtccttgttttgagcagctcatcaaatgtatatgccactgagacagccacaaattacaatctaagcggaacaaacaattctaccggctacgagtacatccttgatgactctgccaatttcattgacgatgccgtaaaaggcaagctcatctcacagatgaaaaagacaaccgaatactgcaacatagctgttgtcaccactacctcacatccttacgaaagcactgaaagctatgcagtcaatacctttgaaggctattttggaaatggcgcaaacggtgtcattttcgtaatagacagagatttagacgagatttatctggcttgtgagggaagcacgcagagaaccattccaaactcaaaatgtaactccatctgtgacaacacttatatatatgccacctcaagtcatgattacgactatttcacctgctgtacggaaacaatagaccaggtcaacacagtccttgcaggcggacatatatcacagcctctcagatacatttcaagtatctttatcgctctcgctgccggcatgattttttgctttgtatatgcattatccctgtcaaagggccgcaaggctaagagcaacgagctcatgggtgcagcatttacaaaggtagagattcataatgcacgcgcacgctttatgaaccagacaagaaactacagtccacaaagctcaggctcaagtggcggtcacagcggtggtggaggtcatagtggcggcagtcacagtggtggcggtcaccacatctagtacaccttcaagcacagtgtggatgtggctactatttcaatgatccccactgagattctaaacaagccgggcaggcatcagctttttgttctcagtggttttatagttattaatagcttgcaaaaataaaaagccctcagcactgtgtactgagggctttttgttttagcagtccgtacgggaatcgaacccgtgtttccgccgtgagagggcggcgtcttaaccgcttgaccaacgaaccgtgtattataatatcatggtcaatcggataatgcaagctttttttgaaattttttcaaaaaaatttttatttgttatttatctgcctttttctccttctttactttccttatacgttcacctttaaagcgttccctgagactctctgtaaaggtatcgagatacctgttctccacctttggatttctaaagccctgtgctcggttaagcgcagatttctttaaagcacccattgaatcgatgacgcggtccgcactggctctgatacgttttctctttctgcgctcctcgacagcctccgcaagctcctgtgaccgttcctctgccctttcatcagccgccttcttacgctctttaacctcttccacaacctcatccatataggtgttgaaattgttctgcagattgacgatcgttctactgaaatctgtaagcgctgacacggtgattgcagtgtctacagctaaaaggcccatgagaaacagtgagaaaaactcataccatataggtgacatccagcctgtgatgaacttcgtaaatggtgcaataaaatacaccactataagtcctgccaccccaaagcctacagaatatggaaagcacaccctgccgtttatattaagcggcatgctgctgtaatcccaccaatatgcatgaaacagcttctcaagcgcccatgatgtgccatattctaagacaatgcttcccaaaaatgccaccagaaatatctgccaccatgtaaatgtagcatccgtgtgagcagaaataagatctgctatcgcagtgattgcaacacctccggctccgtaaataggacaaagtggtccatagagaaagcctctgttttcccatttttttgccctgatggtacagtagatgctctcatatatccagcccatacagctaaatataataaaatatacaaaatatcttgataaccacatatataatcctttctcccctgataatttatgatatacagcaaatgactttgattcccttatgtctgcaaattaaaaatcactctccggatacatctcatctaagtatatatcataccattttgtacactcatttgtccatgagtcagcaactttttcatattgcagtcgcagcttatcgacattttcttcgttaagctcgctttctgcttcacatagctcctcataaaccttttctgcttcttcagctgccttcaccaccggctctgccgcaagtgcaagcttccactctaggtacgcctcttctgttgaaagctgtctggtctcatgcctctccctcttagggacagccgcaagtgcctcgaccatcgcagcatcctttgcctgcatgagtgccggcagattgccatcctttgatgccttaagccttgaaatataatggtcatagccaaacggatagtacatcactttgtccttttcaaagaccagtatggcatcagccacctgctttatgaaatacctgtcatgcgatacaaagagcatggtgccggtatatgccttaaatgccgattcgagtgtctccttcgccggaatatccatgtgattggtcggctcatcgagtatcataaggttcggacggcctgtcagaagctctgcgagcacaagcctggacttctcaccacctgagagcgaactgatgcgctttgaggcatttgcccctccaaacagatacatgccaagcgtctttcttaagtccttctccacaagtgccggaaaaagctcgtgaaaatggtctctcaccgtcttatcgctgtctataagtgccgactgctggtcaaaatatcccaccagcagattgctgccgagctggcttgtgccctttattggcggaacaagtcctgccacagtctttagaaatgttgattttcctatgccattgtcaccaattacggcaatcttctgaccacgccttatacgaagcgacagctcaagcagtgccctgccgtcatatccaatttttaattccttcgcctcataaacccatttaccgcccgaaaactgtggctcgatattgcctgtaaaaatatgagcttcatcttcaaccggcttttctatcagcttcatgcgtgccagcatggtcttgcgtgagcgcgcaaacgcagctttcttaggcttatgcttgaatttctcgataagctcattattgtgcgcaatctccgcctgctggcgctcgtacgctttgcgctgtatctgcagatttttaagcttctgctgcctgtactgcgtgtagttgccggcatatcggtgcagactgccattttcaagctcataaactgcacctgcaaccgcatcaagaaatgccctgtcatgggacaccataactacagccttgggatagttaatcagataatcctccagccactccactgttttcatgtccagatgattagtcggctcatccaagagcaaaagatcaggcttctttaaaagcagctttatcagagaaatcttcgtctgttctcctccagaaaaactgccgagtgtacggcttttttcttctttttcaaagccaaagcctgtaaacagcctgtcgtactccatctcgtagtcaaaccgctctttggaatatgtatccctgtccggacagctctcaagaagtatttcctcgattgtcttgtcctgattggaggaatcaacctgacggagcattccgattgtgatatttcgcgaggttacgattccaagactatttttgcaggcagtctctttgccatgtgctcctgacgacataccgcgatggtcatcgcggtcaagctgcatctctcctgcaagaagccgaagcaatgtggtctttcctgctccgtttttgccgacaacagctattttttctttttcctttatataaaaatcaatatgggacagaatcgtctgacctcctgccgaaactgtcccatccttaatctggtataacatatctaattaatatccttcaagctgtccaaaagttcgagatccgactgtaaaaccctgatattggacgtaaccggctcctgtcccggctttgtaactgtgatttcaataacagagtctgccgggatgccgctgccgaatgcatactgtaaaaaggatacaaactttgggtggtttgctgtaaatgtattttttgctttcatcattttcattatgcttgctgggttcatgtattttctccgatcttatctatatgatatctctttcgacgcacatatctttacgttcgttatataaggtatacatcgaattgcatgcaagcatgcatcgatgataccttttgactctttgattatattataccatgagtcaattctataatctatcattttagaattatttaatcagcaatcatttagttatttcctgcatttttctgctgatatactgcataggtgccacaatgtttctcaaataaaaaatatgccgtatctcatatttcaatatactaaaaaacagatgacccacataacatatatgtaagccatctgctctgatgctaaaactaattaaattgtttactccttcacgcctccaagtgtgacaccggcaataatatattttgataagagaagatatacaataataataggcacgatagctactgttatcatcatatagatttttcccatatcgaaattcatatagtccgctcctcgaagtgtggcaatcaaaattggtactgtcatcttgttctttgactggatgaccagggctggtgtgaagtagttgttccatgaacctacaaatgtgaaaattgcctgtactgcaattgcaggtttcatgattggcaatactatatggttgaatgtcctaaactcattcgaaccatcaattcgtgcagcttctacaagtgatagaggaagtgatgactgtagatagctgtacatgaaatagaataccgccggcgatgctattgatggaatgataagtggagtccacgaatcatacattcccatatttgttattaaacgcaggaagcccatcgcagtaacctgtgtcggcataaccagtatcgccattataaatgtaaatgcagctttctttaatttgaaatcgtaagcataaagtccatatgctgtaagcgatgaaaaatatgtacataaaactgcacatgagcccgatataataaggctgtttactattcccctaaacatagggaaggatccgtcattagctacagatttcagattatccaggaaatgcccgcccgggataaatgagaagcccttctgcagctgtgcatgcgaccttgtcgcattgattataagtattacaaagaagaacaggcataaaaatgataataatatcaaaactatatgcgctataacactgcggacattaattttatgttttggtttcattatttagccgcctcctttttctttcttctagcttcttttgcagctcgctttgctgctacctttgatccgtcaggatcgctgtcatttgtcattctgtatacgatgaagcacagaattgcgctgactataaacagatatactgacaatgttccggccataccatagttcttactctttaagtggttgttcaggaacatgataagtgtcattgacgttctgtccggatttccctgtccgtttgtcagaatctgaggtacatcgaacatctggagtccaccgatgattgatgtgatgagtgtatatgcaagtattggtcgtatactcggtaaagttatatagaagaatctctgcaatgcattacatccatccagatctgccgcctcaaatacttctgtactgatacccatgactgctgccatgagcataatagtcgtattaccgaaccacataaggaaattcatgaagccgatgagtgatctggttccaaatacacttcccataaagtcgataggcttgctgatcactcccatagactgcaggattgagttcacaggaccactgttcgagaacagtgtaaagaacaaaagtgcaaatgcagatgccatgatcaggtttggcagataaattactaccttaaaaaactgtaatttgtgaatttttaatctggcatcagtgaaccagtttgctaaaacaagtgcaaccacaatctgtgggataaatccgataacccagaggataagagtattcttaccatatgtgatcatatccgatttaagaagctcggcatagttagcccatcccacaaaattcggtcctatttgtttgattccggatctatagtattcaaaaaaactaaaccttaccgtatctactaacggaatcagagaaaaaattaaatatgttatgaaaaacggaagaataaagatatatccccattttgcatagcttacgctctttcttttcttcttcatgagccaaattcctttctaccaaagtcacctctgcgaagcccaaaggctccgcatggtgttttatttatcttatttcggccatgtaaccttttcgatatcaggataacgctctttaattgctgtctcaaagtttttcttagccttatcataatcaaccttaccctgtaagtaatcgctgaatgagttctggataagctctacacatccctgatcatatgctgaaagaggtgcaatcttgatattctcagctaccggttcaaagtaagcaaatgggttctgtccgccaaggaagtctgatgcgaatgaatcatcttttgctgcttccttcattcctgattttgtattcgtgaaatcagagtaatccttagagatcttgagtaagttgtctttatttgctgttaaagcaaggatgatatccttaacatgcttagggttatctgttcctgttgctgcgtggaggtaagatccgccccagttgtaattctgtggtggtgttgtaacagcccatgatcctgctgctccatcccagtttggtgcaagtgtgaaatcgattccccatgctgggaaaaggaatgcaaatacctttgactgagaacccattgctttgttccagtcatcattaaactggcctttaactttagcatcaacatatcctgcatcaagccactcttttgaatcatctacccagtttgtaatcttcttatccactacaacctcatctgctccaggctgtacccatgagttgtcgattgagtttccatataaacggaatgtatcagcgtaagaagataatgtgtagtatccctttgccttaagttccgctgctgtagcctttaatgtatcccagtcctttgtcttctcaccgattgcttcaggatcatctgttccgaatacatcctttgcaatatcgcgacggtaaactaaaagtccaggacaacactgccatgttgaacctctctgtactccgtctgaatcagaagctgtttttcttgtgaaatcgaactgatcagcaaactctttgtcacaatcaattccaagatccttaagaggcattgctacgtctgcatctttatctgtatatttgaatacgtaatctgtctctgataagaagagatcaaccttgtcatctgctgctgcatccgcctgttttgaaagagcttcatcaagcttctgctggtaaacaccatcctggttaggatttactatccaatgaatttctgtaccatccttgaggtatgtaattgtaccatctttagaagtttctttaacctctgggtaaacagcctcaactcttgttctgaactcgtcgttccatgaatagatattgataacctttccctcttctgcattagaagcgcctgctccgccttctgttccgtttcctgctgttgttccacatcctgcaaggagtgttgcccccatagacagtaacagcattgtgctaatcactttctgtttcatttttcatttcctccatagaaactattttgatatctcgtttacagttgtaatattactccttaaccgttttcgtttatattaaatcaattgtaaaaatatcagattcatgtcataataatagaaagatgacataaatctaatattttgttgcaaaggagaacctttatggcactttcaaaagaatggtatgacgcagaatttgttgacagcgagagcgaaacactgcatcgtgctccaagtattgaatatagtttttataacgcagtcaaaaccggggatatggaatatgtaataaaaaactgcaaagaagatgcatttatacaccttgaaggaacaggtgtattgtccagaaatgctttacagaatatcaaatatcactttgttgtcacaaccgccatgatcacaagatactgtattgatggaggactcgagcccgagcaggcataccgtctgagtgacttctatatacttaagatggacagttgctccaccgtacgccaggttgctgacctgcatcacgagatggcaaaggatttcacaggtaagatggtgctgcagaagaaatcgtctatcctctcaaagcctgttacccagtgtgttgactatatatacagcaacataaaagagcgtatcacaatagctgatctggctgcatacacaggtctttccgagagctatctttcaagggtattcaagcagaatctcggtgtttcgataagtgattatataagggaaaagaaaatagaaaaagcgactcacctgctcaaatactcagataagccgattatagatatagccaactacctgtcattttcatcacagagccactttatccagatcttcgagggttttacggggcttacaccaaagaaatatcgtgacagatactacaaatccatgtggtagcctgatgccacatgccttgtactgcgcacaaaaaattcccacacaaacatgcgtgggaatttttatttagctgatacccaatatacgatatcaaacgctattaattttataaactatcactctatgtatatctcaaccgtatgacatttgtctgtagaaagcatttcaatagcatgccttggaatacgcacgctgtttcctgtaacattttccacttttacagcatcacagagtgctcttttgacctgcgcatccccaggttcgagcttatcaggattgtgaactaaaatatcaaatccatgacctgcaaattctaacgaaacttttgcatcacctttttcgttatactgctgtggcatgagtacaggctcaataacaagatctccaagctctccatggactccgtatacagatgttatcatagtaagcatataccagcttgcggcacctgtaagatatgaatacagacctcttccatcattatcaaaatactccggtactcccggatacatcctgcttctgtcaaagtccatcgcagtatcaagaagcgtctttaataccttgtaaccctcttttataaagccctgtttatagagcgcattggcatacattacagccatatgtgagaatacagcaccattttctttttcaccatatgcaaatccaaacattcttccaagatcaaacttttcttccttaaaatcagtgtttagtctgtagccaccggctttttgatcaaacagatatttgtctgcgctattacagattgccttgatctgttctttttttgcggttccactcatgatggcaaatacctgtcctgtaagcatcatgcgtacatctccactctcacatcgttccaccggtctgccgttattgtcataatatccgttgaaccagcctccatccgtgccatctgatatccattcgttttcgcggatgtttttcatcatccactcagccttatgctccaggttttcgcaaatcgcagctattgggataagagcagtgcctccgcttgtgcagttctcacatgcctttgcatagctcatgagaagctcctgctttttgtcagggcagttgtaaagtatttcgtcatcagcaagcagcagcttaagctcatctaacacctcaatcctgtttattccgcttattttttccacatttcttaaacactttgctatatcaagcagatttccggcatatgcacatgtaaatgcaacactttcgcctttgtcccatgccatatcgagcgcatcgttccagtctgcaccatgcagcttcatctcgttgtgctcccccacatcatagaaagcgcacagattttggatcagaatatgctctaaaaccgttccaaaatatatctgaccgcctgccgtcctttgtttgttaccatatgtagtattccatgcttcatcatggcttgtgcctctcatggactggtaatccttaaagtacgtcgtatgctcaaacagtacatctgtatcaccggtctggtcaatataaagctttgtggttacaaatggccagaatgcgtgatccatccatacacgtgtgatgttatttctgtcagcaataaactcgccgggctcgtttcctataatagtcgcattggttccatcaattctcacaccgccataattgtttacaatcatcctgcggacatccgaaggctccataagtaaaagtgcaagacagtcctgccatagatctctccagcctcttccaccttttccataatcatgatgtggaaggaatgaacagccgtatattcttcgcaagataggttgaaaacatatccatttaagataattgtcctccttggcatttcctgtctcaaaatcaatatttaccttgtctatccagtgtttcttgacggtgtttagttcttcttttacttcaagtacactgcggtaccgtccggtaatggcatttacgtcattttctttttccgtaagacctgcaagcatgatatagcttaccgtctccagcggttttataatacggtttgcaaattttattgctccggctgcttcttttccctgaaatttttctccggcctttgcacctgctttttcagttctgactgcctcaggaataaggaaagaacctccctctcctataaactgctcaacggtaggatagaaactctcaggactttctccgtttccggatgatccatatacgaagtagcttatatcatttttccggtgtccacgctcatcaaatgagaggacaggtgtaacctcaatgccgtattgtgtggtttctattctgtgcaaaagtgatgtcacatgtctgtgatccctgatattgtcagcacttctgccatagattgggattgccccgattgggactatctccatagcctcatctgtcttgttagtgatctccacaagcatgacttccatgcttccatcaagtgtgacaaatgatgtcgtgtcggcctctaacccatatatctttgaagcacggtgcagcttctgccacattaaacctgcctcaagctcactttcatcctgattacctgtaaatctgtcggcctcctgctgtgcagatgatccgcatactgaccagaagcccttccccacaatccgacaccagaaatttctggtgcctttattgttgtggagattttctatactaacaggttccagaagaaatgtattctggcttgttttactgtctccgccgagagttggtgtaatgcttgatttaagccctttttcccctgcaagcggcagatacagtccactgtagttttcgggatttttgatcctgaaggttccgtatttgtctataaaatctatatctttcatattttcaatcaatcctctatacaattacaaatcaaattttcacacaccatatacaatcctatagcagtcattatcacacctacagaaaatttacatggtaagctcaatctctgtctgctcgctaagaagctcttttgggatatagtctccctcaaccgcctgtccgtttacaagaaggctcttgcatccgctctcaacatgatcaggattttttacaactatatgaagatggcatcccctgaaatccttctctatctcaaatccatcccaagcttttggaatagacggagcaatatgaagtccatagaaatcaggacgcataccaagtattccctctacacatccaaccatgactgttgaagcagttcctgtgagccagtgtacatgtgaacgtccaaagtttggacttgcttttccttcagtaaactgtccatagcagtacggctcaagtcttcttatctctgctctgtcattctgtgcggcaggagcattttcaataaaatacttaaaagctctgtctccatgtcctttaagtgcctcagcaagaattatccagccctgtgactgtgagaatattcctgcattctctttagttcccgcattgtatatcactgcgagtgctccgtcgaatgcatgtgcatgatatggaggatccataagaatggcgccatactcggtattgagtctttcatataccatttcaagagccttatcagcctgctcatcacttgcaaatccacttataacagcccagctctgtgggttgagccacatatttgcctcaagatcatcacgctttccgataacctgtccatcccctgtaaatccacggataaatctgtcctcattccagcaaagctcctgaatgatctttccgagtttttcctggctctcatcaagatatgcgatatattcatcatctttcttataggctgcaaactcttttaatatagtcattgcatagtagaactgaagtgctacgaaggttgactctccatctgcaccaagtctcaggcagtcattccagtctgcgtaaagtcctgcaggcattccatgttttccgaggtggttcatcgaaaaatcaattgctctctttaaatgctcgtaaaccgttccctcatccttgttggcgaatggaatgacctcatctataaatgctacatttcctgtctctgatacatatttgtatacagttgggaaaagccataatgcatcatcagctctgtaagccggatgtcctgtctcctgtacataggaagcgtcatcaggagtatcctcatgtcccggattgtgtgtaaacttgacaagcggaagtcctccaccgttatcaacctgtgctgagagcatgaatctgatcttttcaacagccatctcaggtgcaaggtgtataacaccctgaatatcctggactgtatcacggtatccgtatccgtttctgagtccacagtatgtaaatgatgcagcccttgaccagataaatgtcatgaaacagttatatgcgttccatgtatttatcattgtgttgaactcatcacttggtgtattaacctggaaatgtgataactttccatgccagtatgcgataagctcctcaagttctttgtcgcagacagcttttgtatccgtgtaagaagcaacaatctttcctgctgtctcattatctatcattccaactaagaatgctattgtctttgtctcgcccggtgccagctccaatactgttgtgattgctccacagctattctcgttgtagttgccgtggttgttaagctttccgctctccactccgacaggattgccatatctgtgatattctccgagaaattctcccctgtcaccgcaccagctgtcaacaggtgctcctgcaagtccgataaatctgtttaccacatccttgttgtcaatttccttgccatcctcgatgcggtcaagattggcatggatcatctgacgcactctgttctccacaaatactgtctttgtaatatactgtgaatactgcagattcacctgatcctgctcatagttgctgttgtttgtaaactcagcgtaacctgtaatattaaggcttcttgccttatcagaattatttgtcacgctcaaattccacacttcgtatgtcttgttcagcggaacataatatcttacttctgaatgaataccgctgtaatcagccatcatctttgtgtatgctgttccatgatgacactcactcttgtattcattcaaatcctttcctacaggctgccacgaagctgaccagtaatccttgctctcgttgtctctgatataaatatatctgccaggctcatcgaactgattaaacacatatctcaaaagccttccgtttgcacctgactttgcaaagctgtatccacctgcattattggaaacaattgctccatactccggcgatccaagatagtttacccatggtgccggtgtatcaggtcttgtaataacatattctttttttgattcatcaaaatatccgtatttcatattcattactccattctctacttaattatgtgatctacggttataactgcctccaacgtatattcagcagtaatccattttcgtaatataatatacatttttgcagcagtgtattatacaaaattatttcttaaaatatcagattcatgacataactaaacttattttaccggggcgtttaacatcttcatcgtagccatccttctgatatacacggacataatcgattacatatggattattctcaaagcttgtctcatcgtttggatttccaacccagcttccaccaacagcaagatttaagataatgtaaaatggctggtcaaatggtgccggatatgcaagtgttccctgtcctactgttgttgagtgccattcgctctcctcgtggtatttaactccatccacataccatgtgattttccccggctcccagtcacaggtatatatgtggaaatcatcagagaaatcggctccatccgttatagtatatgtaccctgtgactgtgaatgaggatttccgtaatggagggttccgtaagccttgtttgtctcctgacccattacttccatgcagtcaatttcgccacatcttggccactgaccatatacattctcatcatttgccataagccagaatgcaggaaggtacccctgtccctttggaacctttgcacggcattcaaatcgtccatatatgaaggtctgcttattctgtgttgaaactcttcctgatgtataggaagctgcttcttttgttgagccggtatcaccatcagtaacttttttgaccggatttattattaattttccatcttttacctgaatgttttcagccgagtctacatactcctgcagctcattatttacccatcctttttcatgtgtctccacattccagtcagcacggtttaatgaatcaccattaaactcatcgctccacacttttttgtagccatcatagcttagtttgcctgtctgctgcgccgcatccaacgcaccctctgcaaacgtctgtgacggcatggctgataatactctttttttcataaagtatccctttcatttatagttatttgttatctcgcatcatgttactgtccacacctttcagcgtaacacgtaaccacagcattactataacgattaagtatccttaaaatatacaaaaaacagcacaaaaacatcaaattcatgacattttaattttcctgtaatttccgcaattccctcggtgtcatgccaaactgcgccttaaacatccggctgaacaccttataattcgtaaatccattgtgctccagtatgtccgtgatggaatcctcagttgccagaagctcctcatgtatgtgattgattcttacctgattgacatactcgagaaatgtaactcccatgcattttttgaacatacggcagaaataatcctgattgagtgaggctatgtctgccgcctcctttaatgctattggctcctgatagtttttcgccacatatctaaggacatccttaagacgcgctatctgtctggattcttttccagcattcacctctttgtacgaataatttgtaaacaaaatatataagaattcgttcacttttgccataagccgaagctcatagcccttgccctttttccggtatatatgcgctatcgacttaagaagagacttcatctgctcatattttctgctgccatgctcggtctcatagcactctctaaaccttatatgtccgtaatcgtctatgtagctgtccagatatgcatacggtatctgtaccagaagcaccctgactctttcatagctttgcgtgccatgtatcttatttgagttaatgacaaaaaattcattttcttgcaatgtatattcattttcaccgcagataacctgcagtgagccggaaactacatagattatctctatatggtcatgccagtgcctcggtgaaaactgcctgtagtcctcgtatctgtcgcagtagattggaagatgtggtattgatctgacgttttcgtgtgtgtattgctgcataattttctccctgacttactaaatcaaacttcgtatttaatgctatattagcctgagcatatccaattattccgaagaaaacaatattcatagtttgaaattctatcttcaaaatatactcctctcacgcaaaaagtcaatatcgacctaaaataatgtcagtatcacaattgtatatatcgcttttataatttacaatcatcttgtacgaaaagaacaagctcccgacatattaatgtatgggaagctctttaaataataaaaatataagaaaggtaatctgctatgaacaaatggtcacgattcaaattcactcctaatcttccacttggggcaaatggtgaaagagttacaggaagcaaggctcacatagagctttcaaaggaagctgccaaggaaggcatggtacttctcaaaaacgaaaacaacgtactccctcttgcagcgggttctaaggtagccctgtttggaaagggtactttcgactatgtaaagggcggtggcggaagcggtgatgtaaccgttgcatatatccgcaatctctacgaaggacttaagcttcaaaaagagaaaataagcatatttgaggagctgtgcgattactaccgcaacgacattaaaaagcagtatgcagccggtgctgtacccggcatgactatagagccagatgtaccggctgagcttttaagcaaggcacaggcatataccgacactgctatcatctcaatctgccgttactccggagaaggctgggacagaaagagtgttattgacccaaacaacaaggctctctgggactacgaacgcgagatgaccgagaagtcggctgagctttttaaggatggtgatttctgtctctccgtaaaagaaaaggagatgattgacactgtaaaagccagtttcaaaaatgtaatcgtgattttaaatgtcggtggaatggttgatacatcttggtttgcttatgataatcagattcaatcagcactgcttgccttacagggtggtatggaaggcgggctcgctgccgctgagcttctcgtaggagatggcaatccttccggaaaaactgtcgatacatttgccaaatcactcgacgactatccgtctacttacaatttccacgagtcaagagactatgtggactataccgatgatatatatgtcggataccgctatttcgagacaattccgggagctgccgagaaagttgtatacccctttggctatggactctcatacaccacatttgatgtggagactgtttctgccggcgttgtgaattccaactgtacgtcagaggccaataagctttatgcaaaagtccgtgtgacaaatacaggtaaattctccggaaaagaggttgttcaggtatacatcgctaaaccacaaggaaagcttggcaagcctgcaaaggagctcgcagcctttgaaaagacaagagaactgcagccgggtgaatcacagcttatgatccttacatgggaaataaacgatatggcatcatatgatgaccttggaaaggttaaaaaatccgcatatgtacttgaagccggttcatatgatatatacgttggaacgagcgtccgtgacgtgacaaaagctgattactcatatatattaaatcatgatgtaattaccgagcagctttcagcaaagctggttcctacaagtctgccaaagagaatgctcgctgacggaagctatgaagctctgcctcaaagtgagcctgttgacaccgactactcagctattggcaacattgacccttccctgacagagggtgttgctcccggtcagagagccatcccatacttccgctttgccgatggcatggctaaaaacggcagtcacgacatcatggatgttgtggaaggacgtatcacgcttgatgaatttgtatcagagctttccatcgatgatctcattcatctgctcggcggacagccaaatacaggtgttgcaaataccttcggtatcggaaatatgcctgaatacggtattccttctgtcatgacagcagatggtcctgcaggagtgcgcatagcacctgaggtcggtatatgcaccactgcgtttccatgctccacactgctcgcatgcacatggaacccggatattttagaggctgtaggacgcgccggcggtgaagaattaaaggaaaacaaccttgcactgtggctcacccctgccatctgtattcacagaagtcctctctgcggacgtaacttcgagtactactcagaggatccattcgtcacaggaaagctcgcaggtgccatggtacgcggaatccagtcaaacaatgtcggtgccacagtcaagcactttgccttgaacaacaaggaaaccaaccgcaaaaacagcgattcacgcgtttcagaaagagctgccagagaaatctatctgaaggcatttgagatgattgtaaaggatgaaaatccatgggctattatgtcctcttacaatatgataaacggctacagagcctctgaaagcgaggatcttttgacaggaatactgcgtgatgaatggggctatgaaggaatggtcacaagcgactggtggacctgtggcgagcattacaaggagacaaaagccggaaatgaccttaagatgggaaatggatatcctgatcgtgtaaagaaggcttatgataagggtgccatctctcgtagtgagatggagacctctgtaaagcgtatattaggattaatattaaagcttgattaaattttactctgctttatgttaacctacccggttcataatacccgatacttattatacaaaaacaaaaacggacatgcaaaactgcatgtccgtttttgtttttgtatttgtatatcttcaatcattaattctgtattttagcatattcctcaattttacatacatgctcttttgttttttcatcatagttaattgccacaagcaggatgtttcccgtatattgcaataatgaattcggatactgtctctcacgaatctgctgcatggctgtatccgcattcttattccatttcagctccacaacaagcgccggataatcatttatatactcaggcttcggaatataaacaaaatcagcaaagccacgccctgtcggtaattccctgaccggcttaaaataatagttcattgttccaagataagcaatggccaacacactgctaagggaattctcgtcattatattgaatcaccgaggtatactccatatgaatctgctcaatttttgctgccacagtatttacatctttgtttattgttgcattaaacaaatctattgactgtctctcaaactgcatgatttcatcccatttgttttcctcaaccgcatccataagctcattgcgaagttcttcattcggaatatatgccatctgatttttctgattaaaagccagatatccaagatgtataagcaatgtcagcacatcatctttgtttttaaatgataccatatcattctgaaacgtggttgttctaacttttatctcatttcctgaaatcattgaaataatagcggctcttaatccatcaaaatccatgtcaataagcggaatcagagattcatatgtgccagtctgtgaccaatagctttggaagctgcctctcatcatcacgctcactaccgcttttggattatacacatgtttacccgaaagcatatagccatcataccagttttttactgcttcataatccctgtcatactttttgcataactgcttaacctcatcatctgtaaagccaatatatgatgcaagcgctcctgcatcaagcattgtgaactcttcaaaattgttaagtgctgactgagtttttagctttttaattggaagtatgccggtaagataagctaacgcaatatactttgtcggctctgtccctttaaacattcccctaaggaaattaatatattcctcctgcagttccttattattagcctcatctcttatcaacacatcccactcatctattatgataacaaaggtatttcctgtggctgcgtttatataagacatggctccataggctgttttaacagtgtccggtatcacatcaccatatgctattataagctcatcaagaataccgttattgatgtatttcacggtgttttgcacttcgcccgcatccatcatgcaccactggacatcaatatgaataacatcatatttattaaggtttgtctcaaaggaatcaagcctgcctacctttagagtggaaaacatgtcaaaggaatcacatcctctgctataataagcagcaagcatattcgccgtgatggactttccaaagcgcctcggtctgctattgcatatgcatgccatatcagaacctataaccttattggtgtatgccaaaagcatagttttatccacatatatttccgatttcaatgtcttttgaaaagctttatttcccggatttaaaaatcttcccatgaattttcctaccttaatgaaataatttaacaacctatactacatgttaagtatagcagtttttaatcaacttcaccatatcaactttgaattatatacaatttaaactattactttccataaatattgtactcaggcacatccacgccatctgttccggcatagtatgacatctccacctcgttgagtccttttttcttgtcaagaatcacattgtactgggatgaatatataacatctccatttttattaaatctgtattcaatattcactccatctttgccttttaatgcctttctcggaatctttgcaaggaagatacgctcactgtcggaaatcttcttcacctcgactgcatccacccatttgaaaaataccggtgcagccactcttgtatcatccatgctataactgtcgtaatcatagttggctgtgtcatcatcttctgtatcctttaacacatgatagcccatctgtatgctgtccacgccatcaagaccggtatcattgttgttatagctacccgaatcgtaaggcgaatatacatataaaaggataagctgtgagctctttacctcatctatgctatccctgaataaatgtgcagcctttatatgagatacattgagctgtcttaagctgtcatttgtctcacctgtcagctgtcttgcatacatggtgaccatacccttattttccatgaagtctgcatctgccgcaagcgccggggatgcatccgtggaaagtgacatcagatatttgtagtctgtatcctccatacatactgtattgtaccttgcgaccagataatcaggccttgcaaatgcaagcacaagataacataccccgattactattattccgtaccgaaatagcgaaaaagcaggcttacatatagataaaatcactccgagcataaacagtgctatcactccaagtgcccagaacacacaaagcctggtggctgtcagcccgtactctgacacatacagtcccatacggtatgcacttgatgcaatcatgacatatgtgcataaagttattaaaattaaaaatgcatttaatattttattctttctaaacaattcacttccgagcaatacgataatcacattaagtatacacacgaaaagcagctggaaaaagccttctctcgcatacctggcgtaggtatagccgcttggaagctgcataagtcccccgaacagatacacaatctgtataaaacagaaaaatacatataccactgatatagttgcagctacagtgataccgattgcagccggaaatgccggagtctcaaccggtgcatccgatatacgcttcttgctcagatactttataccacagtacgatgagaaaagcgcaaatacaaaaagaaatacaaccttgctcactgtaaataaattgatatcagcaaatattttctttattactgaggcaaaaaccgcatccgcagagcacagcagcaccactatcagcacaaccagaggaaaggcaattgctattccgataaacacataaagcattctgtgttttttcacatgcccctctccggcagttgcatttgcactgtcaccgaccacactttcactacccatattgtcactatccatgcgctcatttctcatatagtcggcaatatccataaacggctcagctatacatccaatcgctccaaacactgcctgaaatgccgcagcgatatactttataagcccccactgtctgtcattgcagaaattgtgaagcagcataaaaacaagaaacacaagtatccagcaaaaattaaatccttgtataattttattaccagtcaagcctgatgataggcctgtgagtatcatcatcacactgtaccatacagtgagtggctttgcctctatatgaagtatcttcatacaatacaggctgtatactcctgtgacgattgcaaacaacgtaacaagtattccacctgtattctcatacaggaaaatggtgtacagcagcgcatatattatcgtaggtatacatagcctgccaaaaaaatccgcgtttctcctgctttgttcacgccgtctttgctccgcttcctgctgcatcttctgcagttcgatacctgacattcccatatgtggctgtgaagtctgtggcgtgttctgtgaaaactgttggggattcatgcccccgatattattattgtccatagctacctccttactatctatgtagttattttctcatatttttcacttaccggcaagctaattgtactatactgtttttagttttgcaatatttttttatcgtgttgcgataaatcacttttaattgttacaattgagggttacaattaagggctacaattgatgtgctaaaatgagatgtttcgacgatatttagaattactgataaaaaaacaaaaaatcgcagataccatattatgatatctgcgactatacttatcttattttctcctaaagacactccaatggataatgacttaatgcagtcatagagttttattttaaactactgctgcacattaaacgctttaattcccggataaactgcgctctttcccagttcctcttcaattcttaaaagctggttatactttgcaacacgctctgagcgcgaaggtgcacctgtctttatctggcatgtgttgagtgccaccgcaaggtctgcaattgttgtgtcggcagtctcacctgagcggtgtgagctgattgctgtatagcctgccttgtgtgccatcttgatagcctcaagagtctctgatactgaaccgatctggtttaatttaatcaggattgcatttcctgctccaaggcttattccctttgcaagtctctcagtgtttgttacgaacaggtcatctcccacaagctgtaccctatcgcccagacgcgcagtaagcttctgccagccttcccagtcctcctcatcaagaccatcctcgattgatataataggatatttgtcacaaagctttgcccagtgctctataagctcctctgaggtgtactctgtgccggcttttggcagcttgtataagcccttgcccttttcactcttccactctgatgatgcggcatccatggcaatcttgaaatctttgcccggctcatagcctgccttctttacagcttcaagaattgtctcgatagcctcctcgtcagatttgagtgccggtgcaaatccaccctcgtcacctactgacgtggcaagaccgcgctcctttaatatggctgcaagtgcatgaaatacctccgcacaccatctgagacactccttgaaggaaggcgcacctaccggcataatcataaactcctgcacgtcaagtcctgatgagagtgcatgacagccaccgtttacaatgttcatcataggtacaggaagtctgtttcccgagataccacctaaaaatctatagagaggaatatcaagtgatacagctgccgccctcgcacacgcaattgatacagcaagaatggcattagctccaagcttagacttgtcctttgtgccatctgcctctatcatagccgcatctattgcatagatatcacttgcgtccatacctgtcaatgtgtcgttgattacagtatttatattttctactgccccggtaacacccttgcccagatatctgctcttgtctccgtcacgaagctcaagtgcctcgaactctcctgttgaagctcctgatggtgctgtgcctcttgcaacagttccgtcaaccagataaacctctgcctcaactgtaggatttcctctggaatcaagtatttctctgcccactaccttttcgatttctaaataattcattatgaacctccttatgttttttctgattcaattttatcctacaatacagtttctctatgtcatgattgtagaattgaatgcaaacatgcatcgatgataccttttgaccctttaatcataaaaatacatatgtgaaagcctgccacatatgcatatatttataaataaagaaaaatgctacacagttagtttaatctaacttatgtagcatttcaatagttcataatgataatatttcccaattatagaaatattatgttctaacatatcattttaaatgggctgtaatcgttgctggtcacactgttaggtgtgaacagcaactatctctctgcctcaatctcacgcgcaacatacacgccgcttgccgacgcatgtgaaagtgaatgtgtcacaccgcttccgtctccgatgatgtaaagtcccttatatttgctctcaagcttatcgttaagctctacctccatgttgtagaacttgacctcgacaccgtaaagcaaggtatcatcatttgcagttcccggtgctatcttgtcaagcgcataaatcatctcaatgattccgtccaggattctctttggaagcacaaggcttaagtctcccggtgtagctgaaagtgtaggggtaacgagtccttcctcaatacgcttctcattgcttcgacgccctctcacaagatcaccaaagcgctgtacaattacaccgccaccaagcatatttgaaaggcgcgcgatgctctcaccatatccgttgctatccttgaatggctctgaaaaatgcttcgcaacaagaagagcaaagttcgtgttttcagtctgcttgtctgctccctcgtagctgtgtccgtttactgttacgatgccgtttgtattttcatttaccacgatgccatgcggattcatgcagaaggtacgcacattatcctcaaaaagctgtgttctgtatacaatcttgctctcatacagctcatctgtcagatgtgagaaaatcagggccggaagctcaacacgcacaccgatatccacacggtttgacttggttgggatatcaaggtcattgcagaccttctccatccacttgcttccgcttcttccaactgagatgatacagtatctgctctcatatgtgctatccgctgtttttactgcatatccggatacattgtctgtgtgagcctcttgtaaactgcaagcatcagcccctgctgtattctcatcatacagcacctctaccgactcaacaggtgtatcaaaataaaaatccaccttatccttcagatgtgcatacatattttccagaacaacatagtttatgtcagttccgagatgtctgaccgatgcatccaaaagcttgagcttattctgcatgcagacctttttgagctttgtgccggctgtagaataaagctttgtgccctcaccgccgtacttcatattaatctcgtcaacatattccatcagatcaatggccggctgcttgccgatatgctcgtacaaggtaccgccaaaatcatttgtgatattatattttccgtctgaaaaagcacctgctccgccaaaaccgctcataatagaacagctcttgcaggaaatacaactctttattttctttccgtcgataggacattttctcttagcaagctcatgtcctgcctcaaaaaccgctattttgcagtcaggattcttctcgataagctcatatgctccgaagatacctcccggtcctgctccaatgattatcacatcataattattcatctgtcaattgcctcccataatacgttgctgtttgtacgcccaaggtggcgcacgccaatcacttatgatactatattttctccattatcgcaagagcaatctctatattccagcaaatctcccggctgacagtcaagtgcttcacatagctttgcaagcgtggataccttgattgcctttgccttgccgttttttaaaattgatatatttgccatggtgattcccacacgctgcgacagctccgtaacactcatctttctctttgcaagcattacgtctatgttaaaaataatctcgccttccatgtatctctcccgctcaaataaaactgtagcgcacacgctatattgtcaaatcactctgctcctgcagatctgcggcctttaccacaagatgtgacaaaaccgccgccacgaccgatgccacaacacaggcaaacactatgaacacaagagccagtatcacccccggatgattcacatatatcctccacatgcagacattcacaacaaaaaaatacaatgcatcaaacagaattattttcgatgccagctttatatgtctcgcattctccaaggaaaacgacctgtcttttccgatattcacagctacgcaccagcccagatacaatataacatagcacggaattgcactgatgataaacagaacaagccatggtatatacatatcagaaatctgcgaatcaggcgcaataagcacatgccctatccatggtatggcaaccgcacagaccactaatccgcaaagtgctaccgctattattactatctttaaccatttttcaagttctttttgtctcatttattcaccttgcttctcattgagaagtccatactctgcaagaagctttttttgatactccttatcctttgaagctttctgcaattcatcatatttgccttcggacaataaaatctgatttagctggttaatcaattctattccttgttctaagccttgttctaagccctgttctaagccttgttctaagccctgttctaagccttgctttattccttgttctaagccttcctcgatagcatcagctctttcaagctcaagctgcctgtcaaattcataatttaactgcatactcttcgtcacctcacttctgtaagtctttagaaactcctttcaaccattaacaaccacttagaaatctgctgtcggactggaaattaaactttcacattttcctcacatgaccggtggaatttagtctcacacactaccttccagtggtccgtttgtcataccatcaaatcagttttttccaagaagttactcctattataacagaaataagcgttttgagcttataaaactcttagaaaatcaagaacttttaaatgagtgtggaatttacttctgcactggaatttactttttcaagttagcttctctgcattgtttggcgtaaaattggcgtatttttgtaatttacaaatttccaccaataaggtacatcacgtttttagtacagcttagcacctgctggaatgtggtcatcaaccataagaagatgaagttcttcatcctctgaatccttaagattgtttactgctgaaagtaacataccacaagattcaattcccatcatctttctaggtggaagatttgtgatggcaataagtgtctttccaacaagctcttctggctcataataagcgtggattccgcttaaaatagtgcggtctgtgcctgttccgtcatctaaagtaaactgtaaggtgtattgtcgtccttgtctgcattgagaatcttagtagtaatgtctatcaaaaggcttttatatattagataaaagcatgtaaaatttcttttacatagcttaattgcggtctatttagcttgtttcttgactactcaggaaaaatatttctaccctcgccccacctgtattttcagaatttgaaagtttaatacctccaccatatttttcagccacagtttttgcaaaaaatagtcccatcccataatgggcttcgccatttctacttgtgtcatccataaaaaactgctctgtgccatgcaataatgcttcttttgtaaatcctgatccgctatcctccacaatgaatgtcagccggccatcctgctcctttgcgtcaatataaatgattccattttcttttgtatgctccactgcattctgaatcatattcattacggcccggaacattggatcataagcaatcgttacctttttatcactttgttccgccttccaatctatcttctggtgatagatttctaccagtccgagtgcctgttcctttatatctgcgaaaaaatcttctaacctcaccattgtataggtaacatcactgcaattccatgattttgtgacatctatcaactgttttacataactttgtatctgtgttgtgccgttcaaaacataagtgatattattcttctgttctgtggtcagttcagtctctgaaagtagttctgcatttccccgtacaatcgtaagaggtgttttaatatcatgcgccaaagcagacatctgttgtttcttttcctgctctgttttccactgcttttctaaagattctcgcaatgcatctcgcatatcatcgattgccgataaacagtcatcaaactctttgataccggaacaggatgtctcatattccagattttgatcctttatttgtccgattgcgtctaatacaggctgcatctgctttttgattctttttccaaaacgtatggactgaatgatgataatcgctaccgctccaatcacagacataataatcatcacattctgtggtcctataaaatgctccctcaaaaaagctgaatgatattgaggtgtcaggcgatattgcaatacaacatattcattttcccttacaattactttataaaaatatttcccggatgcttttccgtactttgcaacattccatgctatctgttcgtattgttctgacagatctccacctattttctctccattctctgaaaagattacataatcacaaagtgcgggaatcatctcagcagtcactttatctgcacgtagaatcgtatcatatgcttcattaatcttttgctctgcataatttgccggataaatacagcccacactaatcaaaaggtacagcagcagataagcaacaatcaccaaaccaactaatgatccaagcatgaccagtacatatctcataaaaatcctgctgagtgcattgcttctctttactcttcccatttatatccaatcccccagactgtttttatcggtgtataatcataatccgcaaattttgctcttatatttttgatatgcgtgattatagtactgtcattactctcattgtcaaagccaaagaccgcttccaatatctgttccttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatctgctcctaaagaaagtccgtttaccagactgttttcctccgtttttgccgtaagaaacaaaatcggacaatccacaagtgccctgattcttttgcataattcgaagccatcaattccaggcatcataatgtccagtaaaatcaggtcataacgatgtaattcttccatattaagtttcagcggattacttactttggtaaccagatgtccatccttattcaaaatgctttctatcatttccagaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactggtttcttccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagataacagattttgaaaatcacctgcattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattagcacaccgctgacggtaataaacaggcagacgaacaggtttacaatcattccaaatcgttcacttaaaaataaagctaccggaatctcccataactcagaaaccgtcagaaacaatactgcaatcaacgctcctttcactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgcaacagaaagataacaaaatagagcaatcatccccggcagcaaaagtgtataccaccagttccaaacactttctgcataagcatttgtcatcccaagagtaaatataaatgccatgacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccggtcagcattttcaatgtggtagatttaccagcgccattcggtccaagcagtccataaatctgtcccttttcgatattaagtgaaacattatttaccgctttctgttttctaaaatatttacatagattttgtgtctgtaacatcatttccatctttactatccttccttctatatttcatttcttactgaaatataacctaacagaaaaaaataaagatttgatgaagatttattcccgtatggaataaaccatcaattgaatatcattatcagaactcggctttccactgaaatcagcaaagctgttacaaatacgaagtcctaatttacagaatatctccgtgatttcatccaaactatataaccttataggatttccttctttcatttcaggcttataaagtgcttctccatacatatagtctacctgcccatatatcagcgtttttctatccttctcccattcaaaagcagataatgtaagtcccttttctcctgcatcccataacttgcaagggaaatgtgtttgggcatagcttccattcatgatatccataaagtgctttccaccattttttaatgctttcgcaatgacagaaaaaatcttatgattttcctcatcgtcttcaagatatcctattgctccatccgccatattcagcacaacatcaaattccttatcaaatgtaatcgtgcgaatgtcctgacaaatgaactttgcattcaaattttctttttttgcctgctcgtttgcataatctatgtacaccggtgtaatatcaataccggtaacatcatacccacgtctggcaaactccagtgagtgccgaccaaatccacatgcaagatcaagtattttttccgtcccttttaactgtaactgcttgattagaaaatctacttgtctgttggtatcttctacccatgacatattctgaatatccagcgtccaatttttctgataccagtctttttccattgctttcatctaaatttacctcctgcttttcatcattcaaaaatctgtcccagaagtttctttttctctttatatggaaactgcttatcaaactcttctgcttcctgctcatctacaagatagcctgtcggtgttgaatactctcctgtaatcccatcaagataaccaggtacaagctctttacacaaaaagaatgatgcatcttccccttccggcaatccatgatatcggataccatactcacttgccggttgaaatccactcttgccataaaaatcaatatttccttcaaagcatagtgctctacagccaagctctgctgctttctccaatgaataatcaagcaggattttaccatatcccttccgtttatattcgttcttgatacagattggtcccattgtcataattggaatatttcttccatcatccgctttaatactcgttctcataaacatattctgaccaatcagcttaccctcttcatcattttctttaagaagcatcacaaaatccagttccgaaacaaatgccggatcatttctaagctgatgcaatacataatgttcaagacatcccggacaatatacattccaaaaactttctcttaccagattttctactttttgttgttcttcctttttctctaaacgaatcataatattacttttttccatttcttttatgtcctctcttaaaaataaaaaccgataatcctgatttttcaatatcagaattaacggctctgcgtcttaagcgtctggctcttatattactttttcatttcttctacaattttgcccatcatctgttcaaactgacattttactttcgtcttatctgttgctccatcatacatgctataatagaaaaacatatttgcataaaatttaactgctttctcttctggattttttatttccatatttttgaacagatccttcacgtattctgccggtcctgatacaagatactgctgatataaattctgcatctcctcactgcgaaactgctctattgtgagcatcttccgaaacgatgatgcaaaatcatcctctgtccagtattcaaacatagacttgctgtatttcacaaaatcatccaatgatacgttatggtattcttccggtgtcttttcaatactctcttgtggcacttcattctctctggcctgttcgccatcctgctgctccatgcgccgcacaatacagtcaaaaatatctcttttgcttttgtaatgacggtacaatgctccttttgtcatatcaagttctcctgctatctggctgacggagacagcctcgtagccatctctggcgaacaaatgcagtgcaacaattaatatttcctcttttctattgcccatgcacatttcctccaaaataaataaacgaccgtttatatttatataatagtaaacggtcgtttatttgtcaagacttttctttttgcctatattagataggttttctgatcatcaaggaatttcacttttttgtccattcggcagagtatatctaactttggaagcatttctttcgtaagcgatgaatgtccttaaagcctgcaacctgctcactattacatatgcttgccttgattactggtttcttattttctttatcatatgtctttataattgtctttttcttattttgcaatttgtgcagacggtctgcacaaattctattctgtttcgttgtcttcactctcctgctgttgaagatagaacattgccttttgagtttcaatctccgctttcagttcttcttttgtcggcaggtataatttgtacttggaggcaaataattgttcattgccgtgcataacagaataacgggcaatatcatcatctgtatcggaacaaagaacaataccgattgttgggttatcgccctcactgcgtttcagttcgtcatacatactgatatacatgtccatctgtcctacatcttgatgtgttatcttctctgtttttaagtcgatgagaacaaagcatttcagtatgtaattgtaaaacacaaggtcgatataatagtcctgcttctccgtatgaatgtgctgttgccttgccacaaaagcatatccctttccaagctccatcaagaatttctgcaaattggaaaggatacttttctcaaggtcactctctgtaaaatctgtattctgagaaaaacctaaaaactccgcaactaccggatttttgatgaactccaacttatcattttgatacggtgcagtcagttccttcatttcactttctacaagctcttttttctgagttttgagcatacggtaataatactgagaagaaatgttcctctgcaaagtacggacactccaagtttgttctactgcttctttctcataccaatcacgagcttttttatcctcaacctgcaaaagtacacgataatgagtccaagataacattggcaaagattttggattcactgagtccaaaatctccggaaactctttatagaaacgaacaaacttatacaatgaactataatcaaagccttttccataattctgagtcaattcttttgataattttttgataagttccgtaccatatttagctctttcatttccttgcatttcttcacttgcaattcggtatcctaaaagccagttcctttgaacaagtgcaatattaaccgcctgatatgcagctttttgtgaggactcaataatcccacacatatcatttaagatgtcatctgttttaacaaaattatccataaaattattttgaccgattttttctaatttattctccatagccataactcctttggatttcattttcaatcattttcttcagatattcttttacctgttcagctggcatttcgtctattacttttttgcctttccataccctgattcattatattttgcattagccatcgtcttaatctttgctgtaaccgctttatttccaagccaatgatacggcgaatctgccgaatttatgctgcggatatcaaagtaccttaatatgctggtggaagatgtattccatgtggaagattgcacccaccattacccctgaagagcctaaatttgaccctattaaaccaatcttaaaccgattaatcttttaatatatcttatcaacctcatcttcatacactgattcagtatgagtatcaaatagcacccactccaccaaatcaaaacaatccggattatcctgcaagaaccggtttactgtatgtaccgcaatctttgctgccaactcaacaggaaaactatatattcccgttgatattgaaggaaatgcaatagacctgattccattatccattgccagcttcatagaattaaaatagcagttagcaagaagctcctcttctctatctctgcctccattccatatcggtcctacagtatgaataacataatcgcatggtaaattataggcttttgttatctttgcttctccagtcacgcatccgtgaagtgtcctacactcagccagaagttccggtcctgcggctctatgaatcgcaccatctacaccgcctccgccaagaagagagttatttgctgcattaacaattgcctgcacatctgttacttttgttatatctccttttactgtcttaatcaaatacattgtttaatattccttctctatctctccatctattccatacattttcttgaatgcatcaaggtctgcctgttttttaatcagcataacctcctctatcttacctgtatgaatatccttaaagcctgctacctgctcaccattacaaatgctcgctttaatcacaggctttttgttttccttatcatatgactgtattacacctttcttcttaaacagtcccattttgctcaccttccttcgcctgtgccatcagcacaagcttctcaaatgactgtgcaaaacgctcatcatcttcatttgtccgtttcctagggtctccgcttccgctccggtccgcgcaaagccgatgtccaccggacatcgtgcgcccttttatatgattcttagccgaacctcgtcttgctttcttattaaggtgtctttccataagcatccggtcaatattttcatccgtgtaccacttgccggattgatgaattgcatatgcacccttaccaagtgccattgcagcaacgccataatcctgcgacactactacatcccctttatgacaaatgctgatcagtttataatctactgcatctgctcctgcacctaccacaatcacatcgctgtaatcagaatacaaaatgtgatttgtatcacacagcaatgtggtggaaatattgtatttctctgctattgtctctacaatgtccactaccggacacgcatctgcatctacaaatatctgcattttctccttaaatccatttcatatcagttataattaattggtgttcgtacttctataagatttcctgatggatcatagaatcttacaagcttctgtccaccttcaagttccgttaatttcgtaacataacttacaacatacttgccagactccagtttttcaataatgccttctatatcattatcttcaaaataaagttctatcatattgttatgtggagttgtatgtatttttgtactatcataccatacatctacatcctgtaacacaagcccctcagacattatcacattgccttccagccttttaatcacacgcagtccaaacagttcttcataaaaatcaattgattcgtcaatgttatcaacaataatcaatacatttttcaaactcatgatttatgtacctgcctctccatttctcgttgaatccatgtcataattacatctacaagataatcctgttgcacctgactcaattccttgccgggctgcattttatgccactttcggatgcactccctacagcatgtagctgttgcgtgctgagcaataaataccggatgaccacgcattggtgtctgcttgccatcatttgccatatatgccggagcttctctctttgcaataaagtccttagcatgttgtcttattgtatcaaggcctttttcatttatgtaatcaatatctttctgtttcagacggaaactgcttcggaacttggaattatccagccgctcaaacaactgcctataccattcatccttcgtcatatcatcaccacaaatcgtatggtttcattgtttctgaatttcgatattcatgtttctcataatatcctatcagcttactctcatctctgagtgccaccatgtaaacatctttattctgtttctcattatgaaaagtataaacgatattatggctttcatctgctgcaaaccagtccactacctgctgtattttatccctggattctggattatgacaatctaataaactttttccgataagtttatctccacctcgcttcgcatagctggtaacagctgccggattcatgtagataatctcatgtttgagattgcatataacaacggatgccctgtcctgatcaacaatgctcttataaaagctgacataggatttaaacttaattaccttttcattatccagcctcttttgaagttgtagtttctttcttcgataataatcgtatatctctccatcaggtatccatatttgtgcctcatttatcttatcaagtacagcttcaacaatctgttcaccagcatccatgcggaactgcttgagatttgatctgtatctctccatgctgacacctcctcataaaatatagttcgctacagatagcattttatattgtgaggtgtacgataaaaagagcaacacagaagtgcttccctccttcattccaaatcgcaaaatatcaagcttgagctattatattctatttcatacttgctttgagtgtcatagccctgcttctttacaacatctaatttataacaccagcctctaaatatggagaatagtacctataaagcttatttagttgttttaattctttttcttcgaaacccgcaatgtcaatctgttctaattcttcagtagggaattcacgttgaagagcagtaaactctctatatgtaagtaacggaattcttaaatcaaatggaggaatatcttctgaaagtatgtccccttttcgctcaccccactcgattccggataaaaatggcaacgaatttcccatcaacaaacttcttacttgttcttctttttcttcatcgacaaccataccaccccatgttaccatgtcagccccgtctgaataactaaaaaaagccatttggaaaaaggaaagtttttttccttcaccatttttattaccaccatttctagtagaaagttgtgagtcaatcatattttttaatacatctacgaaaactccatctctctttaagttatccattaatacctttggaagaacttcatacgttggcgcgtaaacacctaatcccgttcgtattttttcaaatctttttgtaagacttttacaatagtccggaaaagaatccgcttttcttctattggcgatcatactattgaatgaaacaaaaaagatatcgccaggtttaagcttgtttatcaacttattgcaatcatccattattgactggtctatgccataatcataatccaaccaaaaaaagaatggttcaccattatcttcatatgaatcaatatagtcttttacaaaaccatagtacatatctatacactttaaaggaatattaaaatcatatttcttctgatgttccacatcggcctctatgcttttcatcttctttattcctaactctcgatgaaacaaaataaaatccgtaaaatattttgctcccataccaatgtaattatattgagacaaatcaaaagtaggatttaagaccttcaaaagatcacacatcattcggcgctccatagccttctgtggtctcaaagagtaattaatcttactatctgtttcaggcattatcaatcccctccatcatacaataaaaattaaaggtctctttgccaacttcttttgcgcttgtggcatgaagcgaactctttgccttttctaatacggtttttccaactttataagaaaccgttaccatcggttctttctgggcatcctcaactattttttcgatacttttctcatcataactatatggcatattatcagatgaataaaaattcacagatatagaattcatcttctgcagtctttcaacgattttttccttctgttcatcttctaattcttctaacttatcgaactcctttttaaccttatcaaatgcattctttatttcagctaaagcgaattgaaaaacatctgcagatgagtcaacattattctttgacgtattccatggtaatagttctggattagtactattaaaaaataccattcctctaaatccagcatacttattatgaaatttcacaccatcttcagtataccaagtcgtaagttgtgttttgtctgccgaaacaacctctcgattattgcaatatatataccatcctgctttgtctggttcccatctcccctcactgttacgttttgtcattccagcaactacacgaatagtaactacttgagtctcattaggtttatatataagagttttcttgtatggtgctaaatcagaatcacatatcatcgccacttcatcatgttggattgtgagtccgtttattgtgatcttaagccctttactaatgggatatgactctcttcgtcttaccttagccaccaatgaatttacaaaaatattgctctttaatgagttagctactccatcataaagatttgtcactttaatctttgttccacgatcagatttttcatgagctacagttcctgcatcagaataagcatcaaaaggaaagttccactcattattttcagcccattcagacacatttacttttaataagaaatcagaatcctcagcaacagaatctacctcgaagaatcgaccaattttaaagagcgatcttttcattccaataccaaatatgcctgttgtttctacttccttacgatacttagatggttttccaaacttgaatgcatactcgcgcgcatcatctataggtattccaccacaattatcttcaatagaaaatgtgtccttatttaaggttaatataatactataattctcataattactttcaccattacgctttattccatctatagaattatctatcaactctataatagcatcctgcaaatccaaatctcttgttaacatcgaaatgaaaaaatcctttgtaggctctgcatctaccttacctttatcattagaatttttcaaagtatcattatccataaatgcaccttcttatcttttttttaataatatattaatccactgattatcccgatgtatcaaatcttgcgaaatccacatcaataacaaatcagcggtattaagttcatcaattaatttgctcaattcctcttccgaataatcagaatatagtctttccccctcaaatctttcatgtttaccacgcttccatgaggcatataagattccattttgctttaaagcagttatacacttttgtaatgcttctcgcatactcattttgggaatatgcagtaaagaagcatttgcccatatcccatcgaattcatcttgtaaagatatctcttcaattcttatattttctactgtaataccagtataaatagaagctatctcacacattttttcagacgcatcaactgcggttacagtatatccttttaataaaaaatgcttagtatctcgtccacttccacaccccaaatccataattctagctcttgggggcaagtgttcttcaaactcattatataattctgtcatatctatgtccatagtacctttagaatattcatacgcattcttattataaaagcacactgttgaattcatctatatctcccacatttcatattcttgtaacttagcggaatcataaaccaaaccaagattttcttccaaaacattgccaaattgttcaggcgagttccctggtacatacaatttttcagatgcccacaccgcatttaagtgctggttctcacattttttgaaatactccattagaaaataagcttttccttgatcctcattatcaaatattagcttgtacaaatagtaattgtattgcacaaactcacccaaaaatcgacgttccggaagacgattatttttgctagaattaagggacttactagctggagttaaattccacaattcgtcatttgatacatatgatctcggcacaaaatgatcaagatcaaacgcctctattcttaactcttttccagtgtatatctcatatagcggttttccagttatatccactgttgcaatccatagatctcttgcagcctttaacgatttatgcttagcctctacttcaggagcaattttatacattacaccaggaactcccgggtttcgatcctgaataaaaatagctttgttatatctaatccatcccatgattacagcataattttgcatcataaattcgcgccactcttcattaatatgaattcttcgctttaatgggtcatcatcaaaaataatgtcataaaagaactcattatcaagttttacaaaagcattcagatacgctataaatctactataattacccttcttatcgattagattttttccttctttatcaacgaatggcttaatcaatctatatggcacataatctgtcaaacgtgttttgtcttctaaaagcttatcatcatatttctttatcaacgctagcattctgtcatatgaatgcgttttatttgataactcttttttcgagcattcatacaatatccgaattgcatgttcgagaaagttttctgcattaccatttacagtatgccctaatctcagatgataatgagttaccgtcttccacgccccaataatcatttcattgattacatcctcaaatgagaataaatcgtttccatttggaatcaacttcataattgcttcaagccaaaagaatttatatccctgatcattattacttagcaaattctcaaacttctttacatttagtttattggaatacaacggaagttccatcttcctcacatcatccatatcgttccacctcaactataggccaatttgcttcgccacgtttaataagttctcaacattctcacaaatgtcttctttgcaaacatcatgtccccaactaattctaattgagctttcaatttgctcctttggaatccccattgctactaatacataacttggtgagtaactttttgaagtacatgcagaaccatttgacactccgcagtattgtttggaagatatcatcaatgcttctgaagacactccatccaagcaaacatttaatgttgtattaacacaatggtcctgacttccatttattctatatttcattccagaatcattcataattctaagcacttcagacttaatgttttttgctatctcatcgtttttcttatattcatgctccgcgatttcgcatgcaagcccacaaccagcgatcaaagctactggtacagttcctggtcttatcccatgctcttgttgaccaccaaattgtattgccttgactggaggtagtttaaatgatttctttcttaaaactaatactcccaccccttgtggaccaccaaatttgtgagcactaaaagataacatgttataatctaactctctaatctcatcaaccagtttcccacagctttgtgtcgcatcaatgtgaaataaaacctctctatccgccagttcttttccgatctctaatacaggttgtataatacctgtctcgttatttacatgcattacactgacaagtactgtatgttcagttactttctcaagaacagccttcgcatctactcttccgctagagtcaggcgaaacataatcaaccataaagcctttatcttctaaatgtctcaccgtttcaaggacagctttatgttctatagaagtagttactatatgctttttcccacttttttctgcatactccacaaggccttgtatggcaatattattactctctgtagccccactagtgaaaaaaacttcatccgactttatgcccaatagactagcaacctgtttacgggcagtttcaacaacttctcttgcgttttctccatattgatgtgttctactatctgcatttccatagacatttttatatacatcaaccatcttatctagcactcgcatatcaatcggagcagaggcattataatctaaatatacactcactattctagttctcctttaatgccaacttaactaagtcatcatggctttttataaatccggttccacataaatgggaaattcctctttccagatttaatctaaagtattttgctactgtctcttcatccgtaggaagacccatttgaatacaccatgcttttaccagtgcatcatataattcataatagtctccaccaaatgtaaaccacgacatttcgagattactatccgctacaatctgaatgtccgttggcaacgttttttcacttagtgaatagcaaagcgcccaacgacacaaaacattccaattttttatacctgtttttcccttcaatctagataattgatctttagactgttgagaaagtcttacctgtttcataatcatagttctgctccaatcttataaccaatttcaatcgaggtactctttgttaactcgtcatatctaagagtgaattcatctcccacattatctttcataagctcgtaatatcttgaatcgatttctgtatctgttgaaagaataattgtttgttctccagcatttggaaaatatgtctgtatcaaagaggttctgtgcattgaatctaatctagataaaggagtatcaataattactggcagcttcttttttgaacaaatcgccaatgcccataatgtagctattaccatcaattgctgctcaccagctgataatgaatccttctgtatttcgtttccatcttcggaaatatatttcatatttagtgtatctgaatccatttcaaccttatcaattaaattcttcttatttgcaagtttcttgtagcattcagtgatagtttcagctaatactccagtctttctcttttgaagttcaacctgatatctctcaattatccctaatgccatattagaatactttatagttctatctgtactatctcttagctcagcagtagataaatatgactctacatatttactaaactctgacgtagctctgatgacacgcgaatttgctgtacttctttctttctcaagttctgacatctttacttggttatcaacaagtgtttgttcagctttttttatctttttatatataccttgtaattctttatcattaatatccaaactcaaatagctatccaattcacctatttgtttttctaactttttctttgctcgaacaatgccctttgcttccgcatttgcatcatcaagaactccttcaaccagattatttgcctggaaaagtgcctgatctgatagctcataaattggctcttcttgcgaatttccagtctgttgtttcacgaaattcacaaaatctatactacttctattgtctcctgaataatctctcgcaaattcttctagcatctcttccaactgcaagacagcctgtctcataatagcttctgcgtgctcatcagctgcctgtaatttaatatctcttactaaatctccaaccaagagaagaggtaactcgacagcagataactcgtataaacgattctcctccgcatctaattcagcttttagttctgctcttttctgaattgtttcctgcctcttttctacggcatctccacctttaactttataaagctgatgcaaagtttctaatttatcattatcctctacgagagtgtgtgttagtttctctatttttaaatcaatctcagccaaagaagcaatcgccgcttctttttcttctcgtaacttttgaacaccatcagcagtcttattgtcttctccgtccttattcacctttttcaaatttctcaaaatatcattgcttagcacatctaatactgttattcctaacattgaacgtattgcattttttagctgtatatttgtgctatctactgccatttcagcaatcttttcaccatcaaagaagaagaaacttgataatgcacttggcagaatattttcaataaacattggccaattatttgctaaaaattcattatgtacaccatctttgaatacactgatttcctctgttgttttcttgcttaatgtatcccaagttcgctttattacatagttttctttattatcattatctatttcaaactctagttcaacactgcaaatcttatcttctgcacttttatttacaaaagatcgtaaatactgtaagtatgatctatacttactttctgtgtacgcaaaagaatttgccccatataatgccaataatactgcttctaggaatgtcgtttttcctctaccattcattcctccaactagaactattggcttgctattcccaaatataaatttattatctcctgcatatactccaaaattatgcagttcaaggcgttttattatcatctgctatgcttcctcatcttcatcaaactctgagtctaatggttgataatccaaaaacttttcattgtacttcccaccgttttctttttttcgaaccatcatatctgagtaatattgtgttgcatcctcttcatttttaaagaaagtcttttcaaatgttccattaatatcatccaaaattctctttctctgattaacatcagaagccttattctcaatatcaattaacgtatacatcatttcaaatacaagttcttcgtctgggtacatttcatcacaaacctgctttagaatttcccattcttcactttcaaaattctcgttatgtatccattctggatcaacaaatggtactcctattaccttttcatatattttgggtaaagcatcatcaaattcatgtttatcatttacccaaattcttctgatagctttcagttctggaatctgaattaattccaaatcatggaactcctcaggtccattttcattaatatccttctggatagtaagaagtcgctccaaccattgctctctaacttcttttttatatgggccgtgaaaaagctttccgtaattcccctgaagatttcccctcattcttctaaaacttcttctttctctatctccctcttcatttccaaactcatttctgaattcgagaagcacactcatccattccttttcctgatcatttgcaatcattgcttccatggatttgtctttctcaaccattgtgcatacccaacatccaaaacggcttttcccacatgtaggagtagatttatcaacttgcaatggacactcgttatcggcagttgcccctctatacattgtcattaaatccatatttgagtatccccatggatttttatattgcatcaagaaagcccaaacatcatcatctgtccaatcttccataggtgaaaataccaattcgtttgccaatgtaggatttgggctaagaagttcacgaactctctttttctccaaatttgtcattgtacgatttcttcgagtactctcctgctttctagtacctagcactaaaataacttcaccatgttcagctatcttatttttgataaagttatttacaggctgtatttttaatctatctgtacaccatctatatttccttcttggaaaaggatatccacgtccaataagatttacccaaaaagtattattgtaatcaggaataagtctttctgtaatgaaaggtagcttattttcatctgcagattttttcattgtttcaagtgatctttctacccactttgatacaacaggcgattcaacaagcgtatctgtattcataatatgaatcggcttttttctttcctcttcgggcaaacgttccatcgccatccatactaactgaactgccgctgtactatcttttccgcctgaatatcctatcatccacggaatatcatctgccaaatacaaattttgaattgtaactaataacccctctatcaaatcttttgttattgccattttttgacctctattcttcaatcgatttttttaattgcacttctgcatttttttcctctggagaaagaggaatttttatttctttttttattacatttgatatcagtaatgcagcttttttatttgttattattcttccatttttacccacagcacgcatataccattgttttgaatttctgctccaatttatttcaccaattttttctatatacaaagccgggtcaattttattgatataaaaataatttccaactcttccaaaggcctgaataactatactctgtgttgctatgaaattttctctcaaatccactttagtaatctccctattttgaagttcttgccactgcctcatgttctttaccactaattcccagtaacgctgcaaaaactcttcaatgtcatcatcctgaccacgtcctgctatggttttattagctgtataaaaagtattcagtgtaaataagcttgaagagaattttcccaaaatatccttttccttatccgtatacgtatttaaaaaatcaatcttccatatcatatttctagtaataacagccatttcatctcttgaatcatatagttcagaaatcgaatttgatgtcttaacagcattcttattcaaatcagtgaaaatttgctggcttctttttaagcctttatcagcataaaaaactattgagatagtctcattttctaacgaattatcttccttaagcgctgccaaaatagctgactttctatgctgcccatcatttattaggaaatgcgcatccatcgccacttctagaattcctgtatcagcatttttctcattgggttcatatctataatttccatcaattgacgctgccaatgcagaaaaaacataagaatctctgttatccaaaatatatctactgattacaggtattcttgtctcatttaatttcctttgtgcacgatactccggaagaacaaattcctcatcatctgccggaaacaattttgccaacatctttaacggaaccattgctatgtagtattctgattcagcttgaattcctcttacaacaggaaatctatatacaaattccattattcctccaatataaaaaaagatatacttaagtacctacttaagtatatctcccgcatattgtaatgtcaattcaatttagctatttttgaagtttattacaaacttctcaaccaagtcctcatcaactatccaatcaattattttctgattaatatctgtgatttttgcttttccgctcgtaacttttactacaaaatcttttatatcatcgctaagattaagaccctgttctagctgatctacttggtctatcccttcacacaataattcaagtcttgtatgaactccatcgtcttttagagacaatttgttccaatcatttccattgtttatgttagacttaattgttacgatttgatttggatcttgaacaagaccgcccattgaagatagttttgcagataatccagcagtttttttttgatgaaagttcttccattcctttgccagatttggatttacctttcgtgatatatgctgctttgcagtcactaattcagcttcatctacaacactagccgatattacgctttcgagtttctcaatactctcttccacatactgcattgtttcgtcgctcagcttaaactctagctgcttgtttgcagcggataactttgccatagaggtggtaaaatcgattactaatgacgaaaaatcaatatcatttttttgctttttttcagcatcctgcacagctgattctatcgtgtctaattgttttaagcttttaatcgtcttcttaatttcatccgttaacactcttcttcacctccgcaataatatctttacaagtctgtatattttgcttctctgcaatgtactctcctgcgtcagtgtctccatcagatgtcgcatagccactcatgcgatttgcaatttcttgatttgctttttcaacatctgtatttgctaatgatattagtttaacaaactctgacaatcttaacgctggatctttactgaactgcaagagcagttcttgaacattgctcgtctcagctatctgatttgctgttctaagcgcacttaaaatcgaacttgcagacttgttgcatgacttgattagtgttgcatcatagtgtatagcaacactaacatgactaagctgcgcctgattatagaactttttgatgtccgaaataatatctttgatatcatcttcatctttaatatcatcaatatttattatttgatttatacttcgtattttttcgtcaattattcttttttcttcatcaacaacagcattaattctatccaagatatactttagatgttcacttactaatcttctttttcgaactggatcatccaactgcaaatcactttcttcatatatcaatccggtattaatcacttttcgaacggctttgttaaaagctacataatcgtattcataattagttgaatttacagctgtaccttgaggaagattataatactgtaatacacaatttctattgtcaactccatctggtccattaagtttctttttcaaatcattccaatttttcgaatgaccattatctccacgatctggatcatttttctgcaaaagcatttctacactaaagttttgaggactctggtagttcttgcataaaccattaaaaatcaatcgatagtactctgcagctgttgcatatgagaaatagtctatttctgtctgttcatatttcatcaccgactgaactatcatcggttttatgctttctgcccacttttgaactctaaataaataatccgtagatccctcaaagttccatgattttccccccacttcactccagcgaacaaaagcctcaataatttttcttgactctatcgatgccggcaacgtaacaaccgcatcactcttcatagtctgacgttcaaacgcaacaagaaacttattgctagtatcccttacccgcaccatagcatcaattggtaccccttccgatgcccaatcaattaccgcatataagtaagcattaatattttttcttgcatcattcaatgctcttacattagctgtagtttgtcctatatttaatttataagacttatcctctatccatttatcaacttcttttaatgcaattgcaacctgttcattctctttaacaattactttaggttttacttcttgatcatgagttttatgttcagttggcgaaggcatcttaacatctacatctgtctcttcaacctcttttccatcaagcactggcaatccaagctgcacatataccgactcagcaattccgccaatataacgtacacccttcttcaaataaacgttatttgtaccatctccccaaatatacataaattgtgcgagacgaatttttgtattatcatccaaatcatttcgattatatatggcattttgtaaagttggatccatgccttccagggatgatcttttcttaggataatcatgtatttcatcaattgcatttttaatatacggttccaatatatctcgcatcagagctctaggatatctcatattaggatcttgctttctatataaaaaagttatagctctcaatgtaaacggaaacagattaattacagaattgcctagtttgaactcaccccatccatcacctattgtcacatcatgtatagggtaactatccgcatttgctttatcttctaaccatttttcaatctctgtttctgctaatgagaccgtatttaaatatcttgcaaaaaattctattaatccattcgtatcattactgaacatatcatctggcacattaatgaaatgctcaattcggccttttgtatttacacgaaacttatctacataataaccatcagttgaaccaactatagaattaatacgacagagattcttgtccttatatcccttcttatttgtcagcaatgcatccaaaagagaatcatctacaccagaagcagctgtaatatcctcaataagaatagttaatgtttttccctgtttaaaaagttcttgtcgtatttcttgtacaacgagacctaaatctcctggttccaaacccgcacatctttggattactttttcaacaaacagattaatgtaatctactattttttttacaaatacatcattatcaattaatttattcgctatttttcttgctttttcatctgcgccagaatttaaaagctcattaaaaaaatctgaatcaatttcaaaatcagatactacgaattcagctgctttatcattaacctctgtcgttttgttttccgcaaatttacaatatatacgttcaattgggccatcatcagacatcaacttttctttaaatgaagcattttgcaaaagtgcaacaagatgctggcgatcaactcgatttatcattctttctttatcttcgcctgcttttccgtcatcactttctatcaaattcacaaaagtataataaatcgtattcttcaattcgatttctggcatagtggttgatgcagatgtgagttttttatacagatctgtattaggcatatttttgacttcaggtatctcaatcaactgttttattgtgcctttcagtgtattatctgctcttcgaataggcagaactacttcattctcacgttttcgaacctccaacatagtataaaaccagcgaatcaaatgagactttcctgctccacttgcacctttaactagcacaaactgatcttcttcgcttggagtaaagaagagatcaaatacctcttcttcatgcattgggtgctttctatcttgaggtgtaacctcagcctgttccgtaacatagagatttttcataggaacatgcgttgccaagaaatctccctgtgtgttattaattacatccgggcgaaaaacgtctttatatcttttttttgcgacttcaatattcatcgttttacccccttataaattatggcagcaaccggatcattaaataattcattcgaagggtacaatatccatttacttccttggtcactgatgtactttagcgtaatctcgccattctcatgtaattctcgaagagcacttgatattgcgatattcagatttttttcgctctttggatttgcagtaagaatttttccatactgattgaatttcaccatgaattcatccatttgatattctttctttttctctaaatccatcaacttaattacgtctttcacaaaaacgtacgcatttggtagaaaaacaaatccgttcatatacccaaaacctaaaaattgagcccaaaaacgccaccctctggccattggtgctgtaacctgctgtcccgtcctatctgatagataattaagcatctcgctatccgatatagaactatactgatatattttttcgtctaaattaacaatagcatttgtacacctataaaattgctcatcttcgtaattatctaatcttgatattacatacaatcgcaaatcatctattgtcttcagctgctctttaggtacaatagcagaaacgtaattatcttgaatatcaactaattttaattctgttgcagttttcattattgcagaaaaataggacgaaccctcatatattccactaggttccattaattcttgcaattcagcacgtgagatatctttctttgatgttactatcttatataaagcaaatactctcgcaggtattgcttcagtaaccatatttccagtaaacatgcctctcctccttatcttattacagttccatcaacctgatctgtaagcattttccctgtagtactagacacacaaaaatctgattttgctatatgaacaatataacgctttttattcaaatatttatacataatttgatactgattttttgcagtatcattatcatcagaataaatcgccatcactaaaccagatatataaaatccatcatcatgaatctgaagatctcgtaattcttgataattcatataatttaatcctggcatcccgctctccgacacatcttccatagaatcacataccactacattgggtttatatttttgaattagcactgtaggtgaatcatctgtaataacaacagcctcattagtatttgagaagaattctttcatttcatcagatatctctttttctggtccactcacatcaacaactaatggaaatcgatttacttcagttacgattctattttcatgatgattacatcccgggcaacactcagataccaatggatatgtttcaaaaaacatttctgaccagcataaacgatctgaatactcaacagaattccttattattgaaaaagcattttgtgatttaagtgattcttcttcacgtattttttcaaacaccgcttttgcttgatcatcatcttgggtaataacatcatttaatatctttatagtaaatatgtatctattctgtgcatcaagatctaggccaataattcttatctgttttcttctgttcagtaatagtaacacattgatattccatttttcatctgtatcattgccttcttcaaaatagttgatcttattgtaatttggttttgtagatgccattatagcaatagatccgccttgccattggttattcggatttctatacatactccaccaacgcccccaaaacttatctgttgtgagcactttactcacatgattaaaagcattggtaatatcatcatcttctatacacattacacttaaacacggtaatccatctctacctcctcgtccaagctcctgatagtaagtatccgcactttctggcatatataaatgaatgacagatcttacatctgctttatctacacctacaccaaatgcagacgttgcaatcatcagatcaaattcatttttcacccaactatcaattaattttctcctgtcgctggattttgtctctcctgtaaaagtgtgtacatttccaaatccgtgtccttccagatatatcttccacttttcagcttcatacggcgcatttacatacaaaatcattggatgtggtaataacttcaccatctcaactatcttcttacgcttatcactataattattggctctattaaaaataaaacgaggttcttttcttaacgaatcacatctaatttccaaccacttatcgtcaatagcgaacatttgcttaaggaattctacagtatcatctctatatgtagcagataacaaaaaggttctaatatctggattcgctttcaacagttcatttttccatggactcaaacattgataatctactcgaaaaaaatctccccacgcaaccactatatgggcctcatcaataataacattctgcaaatatctatctgcattagctctagttatcatctgactaaactgttcatttttaatcaatgcttcaggtgaaataaatagtagacgagcaaccctattttcaattgatttccttatttcttcaaaatttttaactccactgtagtagcaaaaaatctcgtttttatgggctcccttgatattttctcttgccgcacgctcttgatctatagctaacgaaacagttggaacaataacaattgatagtcccttattctcatatcctagcacctgggtcaccaaactttttccgccaccagtcggcatagatatcaatgttgaatatcctttaggcgtatttaatgctccaaatacacataatttttgctccaacgatttaaaatacctaaatcctgttaggtcttcaatgaacgaatttgttcttaaactatactttgtctttctttcaggcgtactggtgttaatatcaataaatgcatctgatacaaaagcttttctcaaaatgtattgaggagtgtcataaacagcataatatttcattcctgacgaatcgtaatatattccatattgagataagttctcaaagcttcctgcatcatcaaatctaattgaaacttgaaatgacaacataaatgatctaagagcaaccaaataatctgcagatccacattcatcaataacatatttttcatacatttttaataaacgaattgcaacattttttaaatactcatcgacagcagaagagtttgaatttaatgcatccaatacaagatcagatttctcattatttattactttttcaatttcgttaacgatatattctttatccattattttaataaccacataaagcaagcagattctaaccgaattattggttttgacaaacttccatagattatttcatactgttgccttaattccttcatcgagtcagtttctattgttccataataatttgcatgagattctttcatagacaaaatctgatctatcatttctttagctccagacaaattggattctttttggaatctctctctcgctctttttcttgcaatttgactactttgatctattagtttttcccatttttcctcagaatactgacttttaaaccagtccaaattactagcgcgaaatctagatggaatccctaaaaatccatcttcctttcctcgtcttcctaaatgatcaattgcatctgatctattaaaatatcccatctgcgttaaacgtttatgttctgacagaacaatcttatctggtacttcgctatatgcagaaaatccaaccgggatgacctgcattgaagatgccaaatattgcctaaacattcccaatgcatatagtgatacaccagcatccaataatagtctttcatttggttcaattgaatatgtataaacaaagcctttccaatcaacagtagattgtgcagccaaagcagtacacattcctctgtatgatctcatagcattttctactatacaatcaaatatttcatctcctggcgcatagaaatgaatataatcattttttatcgccatttgacgattaaaggttcccattatagttctattatcatgagttgtatttttttctttctcctcttcaagacctttttgagctttgactgcaacttcattttgttttttagacatataatgctcccaatttggaggaatcaagaatgaattctgcgctgaacgaactgaaaaattgttttcatcaaacgcaacaaagccattaagttgtccatgatgtaattctccaaatcctgcaagagaagcccaactcatcatagtatcagcaaataattcattttcattaaattggtaatttataagcaacttttccaactgcaaatataacggtctgaatcgcatagctgccgtatcgaaaatttgctctctttgaaccgtctcacgcattgtttctgcttctttaataagttctggaatcaaacgatataacccaaattcgaaatcaagctttatcgaatcaattattttattgtttatatcattcataataatttctaacccacttaatgattgacaaaaaacatttaatccttcattccaaaacttaaaaagttgttcttcataactatcaactgtatgtattactattgatgtaaccggcttttcaacatttcttcctattctatctaatcgaccaattcgttgttcaatagtgttgatattccacgggagatctatatgaataacatagtctgcaatttgaaggttacgaccttctcctccagatttatcgcaaagcaaaatcttacattcatgctctgactggaatctatatatgttaatctctgcttcatctcgattaattgattcagcataaccagttacttcatctccaaatatccgcttaaagacttcataatacgcatcaaatgtttctatttgatcagtaaatacaactattttctcatcaaacaaattttcatcgatataacttactagcttaatcattcttgaaggatgactttctacatcatccatcacattagcaatattatttatggcttccttttcatcgtctaaccatcgcgaagctgtcttcactacttcttctggaatggcaactttactgctaatctctgaaagtcttgcattatatgcccaaggcgaactaaaaaatgcttcaataagtggctgtataatttcagttacactagtttcctgtatttctccttcttgtgatagaatccattcctttaattgtctataagcttcattttcataataattaatctcttcatttatctcataatcaatttcttgtattgatctttctgcaaattcaccttcagcatcttttggatagacccccagaacagctcttcgaccacgaataatatttctctcaatttgaaaattatcacaaatatatgaaacaataacctgaatatcatatagaccaaagtcctcaatcgttgtgtcaacccttgacaccatatctgataattttgcatcgtttatcacttcttctaagtcatttaagttttcttctatcacttcaatttcttcttgaacatcttcgtcttcatgcggattttctgcttcaatttcaggcagtaactcatttttaaaactatctacttcatctaaaagagaatatgtcaatcgagatatcttattctgtttttcaaccaattcagaaaatctctctagcgaaataccatcgtatttatctggaagtatcagtcttagtaaatccaagtattcctcttgtctctgttgaattggtgttgcactcagtaaaataacattttccgagttcctgcttaaggcatgaatatactcatacctatctctttttttcagatagttgtgaacttcgtctacgacaataaaattccaatcttcaatacaatcatctttttttagatcctcaacagcaataagagaaatataattctcgttttcgttttctccttctattaaaccaaacttgaataatagttctgttctccattgtgcaacaagggaccttggcactgtaataagtacattttggtttgctttattggataaatagatttttaatacggagcaagcttcaatcgttttgcccagacctacctcatcggctatcatgtatctgcaataatcattttgaagacattgcattattgtattaagctgaaatgcctttaaatatatcttacaaccagcaagttccttaaatcctaaaattgaattatccaaaatattcattgtatcttttactatctgtcgacctaaataccaacaaggattctgaaactcgtatttttttaactgatgtattggattcgcactaccagctataaatgatgctattaaatccttttcttttttaaggcagtactcttttgtaatagaatcttgtaaatagtattcatagaagtcatcttcttttcccttatactcaacaactattgctttctttcttccatacttcaccattgaatttttaaacaaatggcaatgatctagcgcctccagtggtacttcttgaacttcatccggaatatactcaaagtattttttctgatcaaaaggatctgaaaactttatatgcgccgtctcattaaacagattaacactaataaccttacctgttgcaaaaacacgcggattatgtggatgttctctatcaataggacacctcacaaacattccttctttgatcatatcagtacccctttctaagccttcttcgatttaaagctttctaaacaaatgtctttttctgagcatgtagcacacaaagcatttaacgtctttttatatgtaacatcttttaggctgtcctcattaagaatatcatcgacttcttgctgcgttgaattcttaaatacttctttctcatctagcttagaattctttgcaacctttgtagtaaggaaatcttctcgctttatcatgtgatctatttccttatctttaatacacataaactttccattatacaaaacatatttttcgagataagcaagtgcgtttctcacaatatcaatagaatctgcataattaataaaaacgaacttgtcttttagttcatccatttgatcatttagataatcaaatacaatattctttacaaacactttcccttcaaaatgccttctcgctctatgttccaatacaattgtcaaatattttcgtaataagaattcatctttatatacactcttttcctctataacagattccattaaaaaacgatacttacacaaacgatatctcattaagtcatattggtcaaatcttcccattttgaagttctcaatctgaatatagtcagatttcttttgatgtaattcaacgacgtccggttcatactgagaaacttttgcattcagtatcctaaataaataatacaattccgactcgccgtcgccctcattctttatgtagcttagttttatagagcatttactatatgccagaccatacacaagagcatatcttctaaagtttttatactctaatcttgatgttacaaatacctgatatttccaatcaactggcgcttgtgctacttcaaagaaattgatatcaagtggccacgaaaactcatcttttctagtaatactcatatcgtggtctgataaacacgcaaaatgatatacttttctatgatgatccttattctttcttaatacatctccgtcaatctgttcgaaattccttacaatccaatttgccccccttccttcactaggaatctgttgcaaatacaactgcattgtttctctaagacaatcaaatgaagctgtcgcttctacatcttttacttcatctagtctttttaatactctttgtacaatttctttaaattccgaatctatctcctgaacatcaagaacatgtgaaacaagtacctctccaatttttttataaaatgacttaaagtcatttctctgatcattgaaatcatcataaaagtatctagtaatatcgttaagctcattcaatgcatttattaatgtgtctatctctccttcagtcacatcgaaatattctacccgcttaaattcttgtttttccttttcgtcttcatttatctcctcaatacgattttttaatttttttagtttttttgtgattccttttattgtggtttcttttgcaaaaaaaagtttagttttatcaagaattgaaattaactctccatggttagcttctataataattccgcaagatagacactcatataaatcattcaaatctctaatacataatgtctgcgtttctggatcccacatattagcgatagataagaaaaaatgtccaatcggataatccaaaaatgctctctctccgaactgctctggaaaatatattttcaaaatattatttacttcactatttgccgcataaagttgttcttccatataataaagagcaggatgcttatattcatcatctttcctgagctgttcagccttctcaaacttcttagcaatataaccagcaaattcagtagaattatcaaactctgttacttcgattcgattattaaaatctatcacgcttgtatttccagctataattgcagcaatattatctgcaattcgaccaccttcacattgttgactatcattgtttaaatttcttggagaaaaaacgacttttgcctcaaatgacgaataaacttcaagccatgtttgatatacatttttgtaatctggctgataattaaacaatacaacaactaatttgtatttgctcagttcctcaatcattctaagcataataggcgtgaattgatggataccatgcactacaattgaatcttttcgtatcttcgaaatgtcttgatttttactttttagcgtttggtttattgttctatctattgcagaatcaatttcatccaacttaaagtcttttttgattttgaaaaatttgttatttgaattaattaactctttatatatctctacaatacatttttgatcatacgtaagttcatctgtcttgatattttcaggatccattcccaattcaaacattgtgcgaatgctttctacaacatcacttctatttcgttttaaggatgttactatatcctcctgcggaatatcatcaaccacagatgaaaaatccatatattctattaaattatctatggctgctctttgactaatcgcgactgaatcactttcccaatcctgatacaacgcattgataaattttgtaactgtagtcagcttgcctttatcaaaatctttattatattgatcacataacccattcactaaggtttgtgatacacacaaatgaaagcagttttgaatagatgcccaatatggctctttatggatttcgtatggattactatatgtataaattgtaattgccattattcaataacctccatataatttccccagcattgttgtacagtactatccaaatccttcatccagaccaaatttctaattgctctagtcagtgcaacatacaaaattcgagattcttctctttcctgctctaacaactccacatcaactggatacccgtcactatagtccatatttcctcttccagacccgtaactatatataagttttccgtttaccaaattcacatttactcccgagtgatatgtactagaaatatcatcagcagtatatggaataacaactgttccatattcaagtccctttgacttatgaatagttgtacaaatcacagtaacttcattgctgtcaatttctttctttctagaaacctcttcttgatatgtggtaatatttatttttagatattcacctatcatattgattgtaagatactctcttgaatacttctgcgttatcttctctaataaacactcataatttgttctataatcaacctgcaaatctttttttgacgaatatgtcatccaaggtcttgctttttcgtaaatctctctgagtacaacaagaacaggccttgtttcaaaatctgctattatttcgttccatttctttccaagaagtaacataaaatactcatccaagattctgactaattcattcagtttctgatttgcagaatgtccttttaattcagaatgctttatcttcatagggacataatttgattcaatcaaatttgctaaatataccttattataaggatgtgtaatggcaagaactaatttaaataaatccattgtagaaggaagtctaaataaatctcctccttcagatactttcactgtaatacctgtattctcagaagccttaacaatatttgcaatttgatagttatatctcacaagaatcgcaattttcatctcttctttactcagcttcttttccttactcaatttctgaatcatttctttctgatttttaatttctgcaaataaatccccaaagaacttttcttgatcttttccatgtgattcgatacatcttactaaattttcttgctcatattccttttttatacgactaattaaatgatcactgtcttcatatggcaacagattctgagaaccaagttcagcaaacactgcatcaaataaatctagtaatcttccatctgttcgataatttctattcagggaatactctttccaaagattagattccttttcaaccttatcaaatgcacttaacgtagctcctctaaatctatagatactttgctttaagtctccaacaataaacagacgacagtcatcaccaaatattttttgaagcccaagaattgtttctatctgaacatcatctgtatcctgaaattcatcaataaaaacatatttgaaatttacacccttttccttaatcttcccctctctaacaagcttattaacattaatcatacaatctctaagactaattaaattgttatcttttagactttcagcatacagcttttcagcaggaatcacaaccttttctacaagttcattaaaatatggaatcgaaccaatggcattgcccaataaagaaacatcaacactttttatatctatgctcctgttatataactgatcacagaaattaatcagcatactctccaactcaaatgatggaatcgtcaattgatgtacaaagtcaggattttcttctgctttctcgctcaagtatgcatcaagttttgtatgatatagttgccttctgtcaaatgtttcactagatatctgactatcaaatccaattcccattcgcatgcattctttatgtaataaagaaatcgcaaatttatgtattgtagaaatctgtatctgactcatatcctcaatcaaatgcatatacttttcatttgaagtaagaacaaaataattcatgaacattcgcttcaaacggctattcatattttctgcagcatcttttgtgaaagtaatcattgcaatatcgcttacaatatctactactgcatctgctgttcgattacataaatatgctactcttgacaccattgagtaagtctttccagtacctgcacctgcagcaaccattatattattggtagatggcgcatgctcaatctcatactgttgaaaattgaatgctgttacttttgacaattcatttaaaaggcacttctgatcttcagaataaatgccttcctcaatcaataatgaattctctacatatgaagctatattttttaccacataaatttcaaaattaaatattgaataagaatccgctatttctgacactacaaactctcttgttccaacaatcaaattgcctttttctggcgaaagtttcttagcaaataacccttcctctactttacatgccaaattgtgtaatgacttctgagagtcaacgaacacaatctcctttattccaaggaaatattcttcaacaatctcttttattttttcatcacttagtgaatctttttcaattcttaatcttgaataccctggatttaaaacctcaacactttgctttaaatcaaaatttggttcgaaatgatgacgaattaacgcaaatctttttgcatttaactcatcatgaggagtgcttttatttatgttgtacctagccatcaatttctggaataaaagtgtctgatcctcaatatcttccttaaataatgtttctgtttcatcagaaacaacatccagcctcttgtcgtagtactcttctttactgatcagaggataacagaccaaatccatgaccaatggattcattcctaattcttgctttagcatgttggccatattaaatctgtaaccacgagcttgttttcttgggctagattgaggattctcctctcccgccaaaataattgaatcctctccgataacattaaaaatatcgtttgcacgccatccctttacctcaacaataaaaagacctaccccttctgccataatacagaaatcaaattcccatccctttatcgatctggtattgtaaacaacatactgctgaggaagatttgcggaaaaacactcccatgttttcttttcaccatcataatcaggtattttatctatcattttagccatagcgtcctcctctacttaatcctttgtcgttatctcaacaatatcatccatagtacaatctaatgctctacaaatctttgcctttacttccattgttacattctcattattcgcgagcttagtcatagtactatttcctattgacgccatttcccgcaactccttcttttttaaatcacgatcaatcattaatttgaacaattttttataagatatgcccatcttttctcctcaaaaataagaaaaacaagtacattacaccaaaatatattataccacttctcgtacccacttgggtatttttttgcggattgggatgtttatttcaacctataaaaaatatcaaaagcaacgatattgtattaatcgttacttcaatacactctctccatcgattttgcattcttcataaaatgcacactttaaacaacattctccacactttctttttgcaattctgcgttttctcattatccaataaattattctgtgcatgcccttcctcccacgtacgatatccttatatacaacctaacaaataagctgtccattaaaaacgccacccaaaaaggctggccacacttctgcgaccagcccaatactctacctatataaattcaacctcttcattttccttcactaacataaaatgaatatcagctgcttttatctgtggtagcttaatccatctattagctaattcaaaactcttctctgtccaagaaatagcaacaataggaacaatatctctatcatcaatatcctcagtcattacttgaccaattgcttctctcatcaaagcatattcctgatttgctttatttccctttttgcctttcttactttctatataatacttgcttccatcaataagctcgatataacatcgccaattcctgacactgatgttatttctatttctgcatcatatccatccagtttgtaaactccctgccaacaatctacatcagaatcaagttttatcaaatcatgccctgatataaaactatttatatcaaaatgaatcgtatctttggttttaatatgagctccatctatggatactttcacagtcttgtttgtcttacgattttttatgtaatacaatgcaattaacaacgaaacctctggttctgtcataattccatccccctacttataattcagtgcaaaatcttctgcagtctctctcatcttcgcaacaacttcatctggtccagtaacctttacatccttacccaaactaaaaatccaaccgaagaactgagggctaacagccacatctactgaaacctgactatactcatcgtcaatctttctaaacgaaatctcttttccaaatctatcaataaagactccgcacatttcgttcttaaattgaatatgtacctttgtgagttgaccgctatacatgccaaatgttgtttttgaatatgtaaccatatcaaagtttttaaatagatccttgccttctctcatctcttcgagaatagaaatgcgcatcatcttgtccacacgatagtgcttaatcttctgatcaagatcatcatatgcaacaatataataattctcatcatcccaggataatgaccatggactaacctcgtaaagtgctccatcatgacgcagttccatcttcttgtcaacattccactgaaaatactggaatgttatcctcgaattttctgctattgccgtatgtatcctgtcaacattgtaataaatgctctcattcatcgtctttacacgaccagccacaaatacttgtctgtgtaactgcgatgcttcatatttacttgccaatccttctatcttttttataagctcatttgacttcttggctgtgataaattttgcagactgcacagaatcaaccaataattttaattctgcaagttcaaactgtctgttacctatatgatacgaatatgtcctgtcttcctgcgttcctataacatccagaccatacactcttaaattttcaatgtcattatataagcttttgcgctccgcacttatatcatacgcagcgagtgcatctataatctccggcatagtaatactgtgcgtttcatcagtccgctccagaagaattttcataagatatatcagtttcaatttctgattcgatgatttaggcatatagcacctccaaactccccgataaaactaaaaacttctcttatatgataccataaataaccatataagagaagttccttcattcctgcaagtcctaatgtcggtacactattatattttatctgcatttgctactttgcagagcaacatatcacaattaaaaccagtactataatagcaattattaataaaacaggctgtgtaaataaccataatactgcgaatagcaatacaaaaaatcctacaaatttaccgattgcagctattcctgaataatccccatcacaagcggcaatgattgaaccaacaacaaatattaaaataaacgtcaatatatgcataactgccacctccgtaaatgttctatttaactcatttatcatgcatctgttccttatgctttatttatagcactttatactgtccaataatcatcccttgtacatcgaattaatgttctgtgttgcaacaaatcggtataaaaaaaggacgcagaatctctcagcttctgccctcttcggttaaatcccttaataccaggaaatgtctcctgtatttctcttgaaatctcatctatatatgcatcgccaacgaagcgtgttccgtatgaatctcctttcgctatttcagttgttcctataacgcaaaaagaggacatcttctatatttctttagaaaatgtcctctaagtaatacaatccaaatttagatgaatttaattctcttaatacagctttgctcctgccggaatgtggtcatctaccatcagaagatgaagtttttcttctccttcttccccatggattgcactaagtaacattccacaggaatcaattcccatcatagctcttggtggaagatttacgatagcgataagagtcttttcaaccagttcttccggctcataataagcgtgaataccgcttaaaatggtacgatctgtgcctgttccatcgtccagtgtgaactggagaagctttttactcttcggtactgcaacacactctttaacctttactgcacggaaatctgacttgctgaatgtatcaaaatcaaccatttcttcaaataatggctcaacttttactttggaaaaatcaatcttctcaactgttttttcagcctctgccggtgctgcttcggaagacctatttgccttcttatcagagtctaatgacttcattgtcgggagctttttcgctcctgctgtaaagagctgtaagatgatttacatttctttaaatcattacaatattttctttagcaagctgtactaaaataaccaaattcgcagccttttttggtcatatattagtcatattaaatttttttggtcaattgcctagccctcaaatcagaggactcttttctatattatattgttgtttctaaaacacatccatgttcttggcaagtttctccaaagcctctctagtaacctccggatttgcctccgcataaatgttcatggttgtgctgacatctgcatgtcccattacttcttgaataacttttacattggtttcgttctcacaaaacctcgaagcaaatgtatgtctaaaaatgtgacatgaaaacctgggcaacattataggttctctcttctttttctttgcctctacctcttcttcggcattgtgagtatcaacgattctcttgattgcacgatttactgcctgcggattatgtggatttccaaaccgattagtaaatataaagtttgtcattccatcaacctctgcaacacaaaaaccttcttcctgctgacgctgatattcagacttgagcacttcatacaccggtcccatcattggaattgtccttattcctgcttctgttttaggttctgaaacccgaaactcacacttaaatgaattgtcagatcttgtgtaataagtaagactatggttaatattgattgttcgtttcttcatatcaacatcgtcccatctgatgcctattgcctcaccgattctgcatccagttccaagcagaaatacaaaaaacggataccaatggaagaaaaacggattctttgcaacataatcaataaattctctctgttgctctactgtcagtgctcttcgactctttctagcaccaccgtttctttttttcacctcggcataagctccatttacaggatttcttcttataatatcatctcgtactgccagctcaaatgtaggtcgcaatacagtattgatactctccaaagtatttacctgcaatcccttgttcgtaatcaaatccgtatagaaaaataagacatcagaatacttcacatccttaatctttttctttccgaacgtatccctgataaaatgatcccatgtatataagtaatttgcttttgtagtgcttcgcaactccgtcttggtagaaatatatctatcaaacaaaaaatttacatctgcacttccagcaacatatacatttaacccgtccatctggtcacgaacaagttcgtcttctttctgcctaagtgttacaagagatttcgcatatatcgtcctttgttttcccaatggatcagtataaatatatgaatacctaccatcagttttacgataatgctctccttttcgtaatactcttcctttaccatcttttctacaagccatcttttctcctttctcaaaaagaaaagagcctgcattacttctggtcagccattagtttctctaacactgccattttaactacttgcgtcatagtcatgttatgatttttggtgtattcaagcagcaattcatgttcttcaccattcagtctgattgtaatcctcttatcagcaggattttcagcctttggtcgtcccatctttgccaatatatcacctccatctgaacatagtatactttatgtcagacataaagtcaagtatattaatgcaaactctttcatattcttttcaatttatttgtagaattcctcgtcttctatatgaaatgtctccagatattcatcaagaatatcaaggttcacaagcaccagtctattcatcttataacatgctttcgcatccttagctaactgctggaactttgataaactcattgagtacatctctgcaccctctggatatctgacaaatctcttgttatttgttttcttcgttctgttatccattttgtttcatctccaattcctctaataccatcttgcgtgctacaggtaacagattaagctgcattatcatcgctctatccattgcttccctaatctccgattctcccggaatgtaccccgacttaaaacggacacatcccttatttaaagtttgaatatcctccggcataaaatcagatctgttgctcaatgagtgccctcttatttctgaaggctcaactatcacatgcacaggattatctttcagttttgatgataatggaacaactgaaatctgaggtgcaccaccatgattacttgcatcacacgagactacaattcccggtcttattcccccttgcacaccatgcggatttcgaccaaaatctgcatatacaacatcaaactttttatatttgtcatatcgttttttattcttattcataatctaaaacccccttaactgcatagccagcctgccatcatctactgtaacaataattcctccggcagcctgaacttgcgctacttttataaatgcgtcaataagattgtctgtaataacactcatgtttgcgactattacaccatctacctgcttttttctaatcttatccacaatctgatgccactgtctgtccacatcattctgtgaaaatccatgtcggcgttcagtgccaacaatcatgtattctttattttttacatactcatgaatatatttactctgcttgtcctctaagcgatccactatatccaatggtgcacttactgacagatactctatacattcaatcgtctttttctttcttctcatagccaaacctcctatgaaacaagcatctctgcattatcaagcatctcgttaaatatcttttgaaaatatgccttcctgctataatccattaattccaacctagagtctattgaattttctttcttaccctctgccacattcaggattgtattagcatctactttgaaataatcaattatcttaaatagatttgtgatacttaatgcacgttctccattctcatactttttgatagttgactcactaataccaagctcagcagcaagggcttcttttgtaagatttctttggattcgtaacgacttaatcacgattccaacttgataaccatcatatttcatcgctatatcctccatcgtcctttgccatttctcttaacatctctacagctgcatcttctgtttcatactgaccaagccacttccctctcgaatcatgtactactgttccgaatgcagtctgcgtaaatctgcaatccttcacagccgggacttgtttgtcccgaccggaatgaatttctgttgtcgatctaccaaaggactcctttagcatccaaagtcctctgcatgagatacagtaattggcactggaccgacttcaagagaatagagccatatgcccatatctgtgatggtcttcacaaattcctccagatcataaatgtcatcggtgatctcattcaggcttctgactactacaacctcaaaatcttcctctttaagtgttgcaaagaaagcattcagtgcttctctgtcatagtcccttgtcattgagcgatcacaatacgcatcatttattattactccattaggtattgcctgatcacgcatactttcaaccatctggactacattgagttccgctctgcgtgactttacaaatgcaataccctttgcaagctcctgattatctgtaccttcgtttcctactaagttaaaatctctttttttcattttgttatctcctttacgatttcgtattggagagttttggcgcctccactctcgtggtgtgctgtatctcaagcacaagtatattgtaatctgccacaccttaattgccgaccgtgtacaggcgacaattatgtcgtgtaaacacgacaatcacttttcaactgacacgcttttcattgctttcatcattgcaagacactgtcttatctgcaattcatccatatctgaaagaacatccattgcctcagataatagttccgacttttcttcattctttccatacattatgaaatcaacagatacaccaagtacgattgctagattatctaatgtctgtgtcttaaaatctccaccattttcaatcgcagataatgcttgtctgcctatacctactctatgagctaactcatcctgtgataatcctatctcctttcttctatcagcaattcgtattcctctctcataatccttttctcttgtctgtgctttactgctcataaatcctccttgccgcccttggaaacgaacaagtcggattacctttacagcacaaaaagacgcacgaggaaaccagtatcataaatactgttcgtttcccctgcgtctctggtgcttccatcttttgatgtgcccttatcaggtgggctataatttaattttcaatcgttatattctgaaagttccattctcagaatgttccttcatcattccctcggaatacttcttgagtatcatcactcgcttgcatctgtcacacttaattccaatattctgaagtgccacagcggaatcatcaccgcatacaaaatattccatcattaacttgttgcattttttacatctaatttctataacattttctttgttcaattcagttcgctccttattcatacaaaatcatcaatctacaattctgtactcgtaaaggaaagggaaatcacctttgcaagccttttgccgagagttccgatgaatgtctgcacattccccggctttgctgatctaaagccaactgatatgaattgtgctgtaagcacacaatcacatcaggctccggctctttccataaaccacatattgttatcttcatagaaaaggaatatttcctttccatctaccacgcaggtataacgctctccaacgccaccagcccttgtactggctgctctacgcttgtcttttactcgtgtaatctcatactttctgccatcttcccatgttatctctttgggaatgagcagtccgtcctttgaaaactctgcaagtacatcaacatataccttattgctcaatgtaatcaccttccttacaagattgctattgctctggaagcatccatcttccttgctatatagcctttttcttctaatattttcagatgtgcataaacacttgaagtcgatgccacccctaccatcttgcatatctccctgatagtaggagcatagccattcacacgctgatattgcataatgctttcatacacattctgctgcttctccgtcaatggtgctctgtctaccagattaattcttgctgcttcgctcatgttccgcctccctcttctttactctattggcacttctcgttgctaacctgaaaagtacccatgtggatgtactgtgtgttcttcttttgcattgactgccgacagaatcctgtcccggtacataagccctctctgtatgctgtaaaatccaaatcttctgcgaatctcatccacagcattatccatcttcatctgcttttcccgtttctccacacttgagaacaaatctatctgctcccaataattatctgttaccagatctgcacctctgacaccaacactacggattggtttgctccagttatagttttccttaaatatctgatatgcgtatgcagctatttctccggtaatatttgtcgcatggtcaatctttttatgacgggtaaaagagaataattcattatccctgacacttatctcaaccactctgcaccggaatccattctcacgaagtcttgctgcaacactctcagccagaatataaagaacaatctttacatcctcatcgcatactaaatcctttggtgtcgttgtgctgtttcccaccgatttgattggagcgtgggtattctccagcttgacaggtgaatcatcatagccattagcaaatgaccataagatactgcccatctttccaaggtgactgttaagcacatcttcatctgttcttgcaagatcacctatggttttaataccaaataatgcaagctttctgttcgtacttttgccaacgtatagaagatctgccaccggaagcgaccaagccttctgcttaaactcactcttatacatagtagtgatagcatccggcttcttgtagtcagaacccagctttgcaaatatcttattgaaagaaacaccaacactcactgtgatgccaagctctgacttcattctcctgctgatttcctgtgcgataagcaatccatcccctttaagggaactgcttcctgtcacatcaagccagcactcatcaatcccatatggttcctgtctgtccgtatattctgcatatatctcatgagccatccttgagaaccgaagatataagtccattcttggtgatacaaatgttatgtccggacagacctgctttgcctgccagagtgccattcctgttttcacaccgtacttcttggcaatatagtcagctgttaagacaatcccatgtcttgcctccgggtctccgcctactgccaatggctttcctgcaagctcaggatgatgcaaatgttcaatcgaagcataacaacagttgatatctgaatgaagtattaccctgtctcccatctgcataacctcctgtatttaatcagtctctaccataacctttagtccaagtatatgagtaatgtttcttacagtgcatagtataaccccaagaataatcgactgtcaacggacatatgtgtcctttttctcattatattggatttttagcttgaataattggtactgttgctatatactatggagtgaaaagagacattagaaatcaacaaaatgaaagaaaagaggcgtatttatgtactcaatcggagaaatcatttcatcatatagaaaaaagaaaggcttgctccagcaggatctcgctgatgaattagctaaggaaggtgttaccatttcctacaaagctatatctaactgggaaagaaatcttgctgaaccaagcgttaccatattttacaaggtgtgtagaatccttggtattactaatatgtatgaagcatattttggagtaaatcctgctgatcctttttcatcacttactgatgaaggcagggaaaaagctatggattatattaatcttctccatgcgtccggattatatgaaaagcagactgccaaaattattccgttccgctgcattgatatttttgaaaatgctgtatcagccggaaccggtaacttccttgtagacggaccaaaagagactgtatgtatagatgaatctatcttaccggaagatactacttttggtgtccgtatcagtggcgacagtatggagcctgagttttctgatggtcagattgcatgggtattacaacaggaatctgttgctaatggagaaatcggcatcttcgctctaaacggagaagcctacatcaagaaattgcaaaacgataaagacggaatcttccttatctcgcttaatgaaaagtatgcacctatccccgtcggagaagatgatcgtttagatatatttggtaaggttctcggaaaatgtaatcctgctgatattgctaagagttacaaataagaccagtgccaattaatgcaagtcctttttattggacacatgttcttgcataattaacactaagaaatcagaatctgaaagaaggaatttttatggcggttgtcaacaatatcaaagaaatccgtgagcagcgtggcatctaccaggatgaacttgctgaagctaccggatactgtaccaaaaccatcggtcgaatagaacgtggggaaagcaccccatccgcagagtttatgctgcggatttcaaaatactttaatatgatggtggaagatgtcttccatgtagaagattgagctgggcacatgatacccagctctattactatctactttcaacataaattttaaaaagcgacgattttcgcaatcgtcgtcagactgttcctgttgggcggtctgacttttttaacgatagtgcaaacatcgtcagaatttgtctgcggtcaggttgtatcatagcggctccctccagtaagccgccgtatccgccagcgtcagcacgtcattccctttgagggcaaaagaaacggcgccctgatctttcaaaaccgccgatagagcatcacatttctaaaatgagcgcacgaaattatctgccccagtcaacgttttttttctttccccggacggggcagataacttattatgcagagcagagcggagccgatgtgcgctaatcggttccttgtactttctccttcagctttcggaaagatgtatcactgatggcgtgttcaatccggcaggcgtcttgttccgctgtttcctgatcgacgccagcagcgataaactgctccataaaaaacaaatggcgttcatagattttctcggcaatctcccgacctatgacggtcagatgaaggaacccatcatcatccatggtcagaaaacctccatttttcaaaacgcctaccgcatggctgatactcggtttgctaaagcccatgtaccgggcaaggtcaatggagcggaccatgccttgcttcttttggagtatcagcacagcctccagataatcctccccggacgcatgaatcttcatcgtagcctccttttaggcggaaagctgctgttctgcgttccacatggcagcgtactttccatcctttgctaacaattcttcgtgtgtaccagcttcggtgatccgaccatcggaaaccaccagaatctgatcggcattttttacgatggatagggtatgtgcgatcatcaccacggtttttttctctttcagtagattcgcaatcgcctgctttaccgccaattcattctcaatgtctagggaggccgtcgcctcgtcaagcagcaggatcgggctgtttttcaaaatggcacgtgctatggaaaggcgctggcgttcgccgccggacaggagatttccattttccccaatcggcgtatcataacccctctccatcttgcggataaagccgtcacagtttgcctctcggcaggccacttcaatttctgcgtccgtagcatccggacgggcatggcggatattctcccgcactgtatcatcaaacaggaacacatcctggtccaccatagaaatctggtctaatacccgttccgcagctatatgattgatcggtctgcctcctatggaaatcgtgccgccagatacttcatagtattttgcaatcaggttcaggatggtagacttgccggagccggaatcccccacaatggcggtcagcttctgatccggcacagtaaaggaagcctgttttaacaccggttccccaggaacataagaaaagttcacatggtcaaatacaatctcatgggaggctgcctgtagcggctccatgctgccggtttcttccggttccttcatcacagccatgattttatttttcgagatcatcagattcttatagctggtgaggtctacaaaaatggaatttgccagcttcgcacagaacaaaggcagcatacaaatcaaaagataggacacggtatctaaagttccggctgcccaggggccataggccgtccagatcacaaccgggcaggacagccagctcaaaataccaaatcccgcacctatcgggagaaccttggcttcatacacaaagctgatcctgctaaactcctgcatggcatggatcacggttttgtttttcagaccgccaacgccataggcccggaaagtctggataccggatacatactccacaatgctgctgacattctctgcacaaatatcgttcttctctttgccatacttcgctacctgccggaaagaaagccacaatccggggatcaaaagcaggtcggcaatcaggaggatcagcccggctggaaagtagatcgtcatcacaaaaacaatcaacatcagcgacagggcaaagctctttgcaatgtccccgatcttatgggtcagaattttttcatagttatttacatcactggtaatggtgttgatataatcgcctgtctgcccttgtgtaaaccgggaaagcgggatacgcttgagatggtcgcccataaacaagcggatatttttactgacttttgcgccgccgatctgtgctttggtatagccatagctgtatatcaaaatacggagcagaaagataaatgcaataacacctgtcaggaccagtacacggttcatatcaaactgaccgtcccataaaaaccgcatgacggaataaagcagcataaacaggctaccagagaacagtccctccaggacagtccctgcaacgccaatataaaactcccggttcttcttccatacgttatttggattcattctgcccgcctccttccagttgataagtaattcccctcgctgtttcgtagtcctcccatgctttccgataataagcgttctctttccgcacttcctcatgggtaccgacgctggtgatcgtatgattctctaccaccgccacacggtcgcacattttcaaggcgctcagcctgtgcgctaccacaatgaccgtcctgcctttgcagaggttctgaatggccttatcaatttccatctgattttccgggtcagaggcgcttgtcgcttcgtccagaatcaggatgggagcatttttcaagatcgcccttgcaatagcaatccgctgtttttccccaccggagaaacgggagccgaagctgcctacctttgtgtcataaccatccggcagcgacatgatgaagtcatcaatctgcgcctccctggcggcagcccgtacttcctccaggctggcgtctgaacccatgcggatattttccagtacactgtcacgggtaaggaatgtcttttgaaatacaatggcaatattcttcaggatggtatcgtagttcagttcattcacgttgatcccgccgatcagcacctccccctcctgcacatcataaaaccgggagatcagttcaatcacggtactcttgcccgcgccggactgtcccacaagtgccatgcgttccccatccctgatcttgaggttgacgccttgcaggacatccgttttcccatcgtaggaaaaacgcacattcttaagctcaatatcatggttttccgggaagtccattccgccttcataaacaggaacgtccaatatttcttttgttttggtaatggcacccaggacattcgcaaagtttgtccccaattcctgcaaaggccggatctccgtcagatacatggagccgacatagacgaacagcaaaaatgcactggccgccagggagcctttcagaaagaacatcccgcccaggggaaccatcagcaacatcccacattcgatcagaaccacaaaggttgcgtaaggaggccccattctccgggaggtttcattccacatggcattctcttcctggatcgcaccggaaaatttctggaacgatttgctccccatgttgtacgctttaatcagtttcataccgctgatatactcgatcataacggaattgagcgttgtaatggatcggttcgcccggtccatcaaatcgtccgtattccgaaacataacccccattaccacaacggccaaaatcaacggcaccagggaaaccagtgccaatgggatatttactgtcatcaaataaatgaaaattgctaccggccctaccatatagcacacaaggtctggaaggttatgggctaaaaacaactccagcttttcaatatcttcattcagaaccgttttaatatccccggtccgccgctcattcaatgtaccaagggggacttttgccagatgttccgccaccatgcagcgcaccttgaacaaagcaccgtaagcacctttatgggccgccacaccggaacacccgaataaaacaaagcgcagggccacagaaacggagatcatcattaccgtctgtacgacaagctcttttgtgcagatatgctggaaagcggcatcaatcaggcgataaatcccgatatacgggacaatgatacacaggccgcttgccatggccagcaggattgccagcagcagccagattttttgctcaccggcccattgaagcagcagtgcaatcctgttttcttttttctgtttcatcacttcacatctcctttctctctgaaacagagaacagttcccggagcttttgaagggaatccatcacaacagggatgtcatccggcatttccccttcatcaaaatgcaggacacgggagcaggtacggcagacaaattcaaaatcgtgggtgacaataaaaatgattttcccctgttcggataaccgttttatcagacctgctacctgcgccatgctgtcaaagtccaggccgctggtgggttcatcgaacaccagcaaatcttttccacagatcatgctgactgccacagccacacgttgcttctgtccaccggaaagcgtgttgggatggcgttcccggtaggctgtaagccccaattccttcatggtttcctctactaaatcttgatccgggtttcggattccgaaggaacattctgcccccacactctccgcaaacaattcatagttcacatcctgcataaccatataagagcgtttcaacctcgccttgtgttccatcggctggtcgtcccaaaggaacgcgccttcacagtctttatgaagcccacacagggcgcgggaaaacgtggtctttccggctccattatgaccgaccaccccaatgacttccccctttgccgcagaaagagcaatctggtgtagaatcgtccgttttttatagcgcagagtaacatcatggagtgctaatgtgggagaggaaacaggcggatgactggccggagggagcacccttgccagatcaaccgcccgcagccccatgtgttcccgttcggtttcgggcagccggagaaattcctccggcgtgaaaatccttgctatttctccatcttccagataaacaatgcgatctgccagctccatcagataatagagtctgtgctccgcaatcaaaatggttttcccctggctttttatcagccgcagatgttctttcaattcctggatagaagccatgtccagattcgaggatggttcgtccagcagatagatttccgggttcatggcatagacagacgcaaacgcgattttctgtttctccccaccggacaattcaaaaatattgcggttccgtagcttttcaatatgcaaatcttttgttgtctgttctacccgttcctccagttcctttaccggcctggcttcattttcaattccaaacgcaatctcactgtccgtatccacattgaaaaactgcgtccggggattctgaaagacggagcccacctttgcggcgatctgatacatgggcaggttgctgatttcctgtccgtccaccagcacacgcccttgaagttctccctggtaaaattgtggaatcaggccgtttaccagccttgtgaccgttgtttttccacacccgctacggccacagaacaagacacattccccgtctgcaattttcaggctgattccatgcagaccgccatgctcctgtccctcataagaaaatgatacattttcaaattcaatcacccggtcacacctccccgcatacataattcaaaaataaagaaagcaacagcaatcaacatcgccatccaatctgcaatcccgcattttatctggacaaggcaggtccggggattgggattctcaatcccgcgagtaacagaggcaatggaaagctcgtccgctgctttggaggccatcatcatcagcggcacataaatacactctaccgtcatccccggatgggaaaggaatccgcccagggagggcgatacatcccgcatccgcatggcgtccttaacaaaatgccagtcctcctggatagttggaatatagcgcagcatgaccgcaaatgtaatgacaaattttttcggggcatggatgcggttcatggcagataaaaactcgctgactttcgttgtggacaggacaatccctgccagcatcccacaagcataaactttatggtacagtccaaggaacgcaacaaacatggtccgtagcgtccccgtcatggccgccatgatccagaccgtcagtacacagaccacggcataaaagcaaaccccttttatggaatatttccactttccgcaaagcactcccaatacagcaatcagcaggacaagtgcaaactgatacgaaagggaaggtgcgaacatggaacacagtacgcacattaaaataagaaagagcttggcccgcgggtcaagccaaagccctttctggacggtgttacccatcatgctgtaatacctgctttttcaaactgcttcttcagcattttgcagcccacaaatgcactgatagaagctgttacaaggagagcggcaaacatggcaataaagattcccgcgtttgcggtcgcctgcatggtgtcgatatagctttgctcggttccatttcccaacatggtctgtgcccagccctggggatcagcgaagaaaacaaggtacgaccctgttccgcccagggagaaaaggatataggacaggctgttgattttcttgctcttgtactgctttgtaccggcgacaaaatccgctacgacggccataatgagatagcccagcgcaaacgcccagtgcataccggtgacaaaccagatgatggccattataacgcccatgatcgtgatactccagcgcttatgtacttttgcgatcatcagcagataaaccggcccggcaagcagagcactcccggcgggcatgaaaaaggtcagcatcgggttggtagcaaaaaagacgccacccaccatgatgaatacgaacaaaagtgcggtgaaaatccctgttgttactaagtccttgacggacaatcctgcctttgcatttacttgattactcatattttttcctcctgcttcaagaacggttgacctaccgcctgaaatctgttatattatgattagttgctgctaaccacggtctatatgatactaactttccgggcggtctgcaatacgttccgggcatcttcgtcctttcattgcaaagctccgtccaatcgtttcaaaggaggccgtcatttgaacaatagcattattgcggattactatgagccgcttttaacagataaccattttatcccggtagatagcaataaccgcttcaattctgccggacaatgctggcggttatcgcctgaatttggggaaggcctttactgggtctatgcgaaaaaagacctgtacgacattaaaatccacgatttctattttcacgaagatttcttcatggaatttaacctgccagaagccttaagcattacccagtatgaatctatctccggggaggaattaaatccctatcggcagatgtctgccggatgtattaaagcctttatcggcggttataagccatacaaggcgctgatccacaaaaaaatccccatccgttccatcggtatcgaagtcatgccggcatactatgaggattatctccaaaagcaatatccaggggattatatcagcccgcttgcagctttccggcagatcgatcagacaacagatttcccagctatggctaaattgctccatgaagtaaaggtctaccgtggggatgggattgccgcaggattattctatgaagcgaaagtagccgaggccgtatctcttgtcgtggaagaacagaaaaaaattctgtcccgtaaagagaaacgtttgtccgagcaggatgtggcgcaactgaaaaatgtgattgcttatctcaatgaccactatgcttttgatattccattagaacgtcttgcaaaaatcgcctgtatgggaaccactaagctgaaaacatcttttaagcagctgcaaggctgcacgatcacagagtacattcaacagcgccgcatgagccaggcagagcatttgctgatcgatacggatttcacaatgggacagattgcggaaatgatcggttactctacttctagccggtttgcggaattatttcgcaagagtacaggcctcctgccgattgaatatcggaaaatggctcagcaaaaataaattcacaatgtaatgccacgacagatcactctacaacggagtttcagtcgtggcatttttctgcttttctttacggatatagccattttcccctttccaaattgtagtattagtagagagaaaaatagaaggtaaggcttgataacaagcacagcaagcgagtacccgcttgcgatttttcgtattttcagatctcttgaccgaaaatgaaaaatgtttgttgagataatctcaaactcttatgaagaatggaggcagcgcatggcgaaccggaaacggaatatccagatgaatttttatgtcacagagaataaaaaacggctcatagatgagcggataaaactgctagcctccctattcgattgtcaatgtacttgatgaaggaggaaaacttgtccttcttattaacactgacaaaaaaagcaaaaaacaggcgcatcaaatgaaactttatcaaaaatattttccgagctgctttaagccacggcggatactgtctcgaacacggcttgaatctacaccttctacttcggcaatttcatttaccgtcattcccagatagtatcgggcataaattcgctttgcctgtttctccggcagcttcatcacagcggcatagacctgctcctgaaactgtttttcctccagaagcatctccggtgtctgcggcttcaacagcactgcattttcaatgccattctcgcaatccagagaatactgtgctttataacgatacatctttcgctcatacgcagcctccgcacgttcagctgctcgaatagtctccattacttcctctgtcacatctacaaaaaagtctgttgtataaacatcaggataaagctcccgaaggttaattttcttcattatgtacctccatttcgattcacgggtgattgacgggtgaatcgaatggaggtggggaacggcagcgacgtacttcgggaactttcccgaaaaatcgacagcaaaaagcgccagctccacacaatgggaaactggcgcaacaagaacagtcattattatgctgaatcacatggaacgataatgccgatgcaatgctatacttgcccggaggaggggcaatgctttttttaattgatgtagatcatgggagctttgaaaaagcaaaagagacacggcaaataacctccaagcggctaccgtgtccctgcaagtcgtcattagtttgtgtaaacgcaaagaaacggcggctctgaaattgtccttcaaaaccgccgattgagttcaaaccttaaaatagcgcacgaaattatctgccccagtcaacggtttttttctttccccggacggggcagataacttattatgcagagcggagccggtgtgcgctaatcggttccccgcattttttcctttaacttctgaaaggatgtatcactgattacatgttctatccggcaagcgtcctgctccgccgtttctctgtctacgccagcagccacaagctgctccgtaaagaattgatggcgttcatagattttctctgccacctcccggcctatatcggtcaggtggagaaatccatcctcgtccattgtcagaaagccgccatcccgcagaacgcccaccgcatgactgatactcggctttgaaaagcccatgtgccgagcaagatcaatggagcggaccatgccctgcttcttttgaagaatcagcacagcctccagataatcctccccggacgcatgaatcttcatcggttcctcctttatgcaaggctccagccggaagcctttttacggatatttacaaaatcctgataaatcccggcttttgccataagctcgtcatgggttccctgttcgctgatccgtccatcagagatcaccaaaatctgatctgcctgacggatggtattcaggcggtgtgcaatcacaagtaatgttttaccctttaccagctcattgattgcctcctggatatagctttcattatcggtatcaacacttgcagtcgcttcatccagaatgacaatcggtgcgtccttcaaaatgcatcgggcgatagagattctttgcttttcgccgccggacagagtagcgccgccttcacctatgactgtctggaatccatctggcagcgccatgataaaatcatagcagcgggctttttttgcagcctcatagacttcttcctcggtagcgtccggtttacccatgctgatattgttgtaaatggtatcctggaacaagtacaccctttggaaaaccatgctgatctgttccatcagttcggcgagaggtatatcccgaatatctgtaccgcggattgtcactttgccggatttcacatcccacagccgcgccagaaggttcgcaatcgtggatttgccaccgccagacggtcccacaagtgcggtcatggtattcttctgcatagagaagctgatgttgtgcaggacttccttgtcctgataggcgaagcccacatcgctaaattgtacttctggctgatctggctgtgcctgtgacagaatatgttgatttccgttatcgggaagttcgggctcgtccaaaacagcttcaatgcggtctaatgcggcattcatcacggtcagtcgggttgcttctccataaagagctttcagaggtccaaagagatcaaagacaaacagcagcacgcccaaaagataagccagggagagtacgccttcctgatgtaaaaaaacggataaaccgaagatagcggcaatacccacgccatagagaatgtttaagccagtggtccacggtgtcattttctgctcaaacttcgtattgacatcccttgattttttgaagttttccgttaattcgtcagatttttctccgagcagattgtaacttttgataaccccaattccttcagcaaaagacaagaccgcatccgtcaaattctcgctttggttttgacgcccgacagcctccttgaaggaaaccttattcatatattttgcaaccagtgatgccagcaaggtaatgattaccgcaatcagcccaagtctccaatccagtacgaacataaaaacagctaaaaccaaagtagacagcatatagctcatcatgttgccaatggtactcatagaaacttcctcaatgaataccatatccgtactgagaacagagctgattttgccaatattccccgatgtaaagtaacccatcggcatttttcttaaatgatttcccaactccatccgtttatcagcaaagatcataaatccagcggcactttgcagacggtcgctcaaatagtgaaccactgtctgaaccactacaacagctaataatccaagtccgacaaacagacaggtctttccagtcagcgtattatcagcaaacccggccaagacgataaacgccatgaagatcggcattttggagagaatggactcgacaaatgcacatagaaatgcagcctgaatacggcttttatacctcccggagaggttcaggattcttgaaatcaatgcaaacatttatcttccctcctttgcagtagatactttccactcggtgctgtcctgagccgctttccacaacttttggtattctgggcaagcttgaatcaactcctgatgttttccggttgccaccatctttccgtgatccataacgcatatttgatctgcgttcattatagcgggaagtttgtgagcgataactaccaaggtttttccctccaccagctccgcaatagcagcctccattttttcctcattttctggatcagcataggccgtggcctcgtcaagcactacaatcggggcatccttcaatattgcccgcgccagggaaatccgctggcgctgccccccggaaagcattttccccgcatcgcccgccatggagtgaataccttgcggcagcttttccagaaactccatacactgggctttcttcgccgcctgcattacttcctcatcggtagcatccaaacgtccaagacggatattttccagcagggaggtgttaaacaggtactgatcctgagccacataggaaatgcggctgttcaatgtctccaggctcatatcacaaagtttctgcccgccaatggaaatgctccctttctgcgggtcatagtagtggatcaacagttttgcaagggtgctcttgccagaaccggattcaccaactagggcagttttttgtcctgcttgtgccacaaaggtaatatcgtggaggacttcgttttccgctattatcggtttcccatctgggccaggctgtgtcgtctgatacgcaaaggaaacatgatcgtaagaaatgttaaaatcctgtccgtggaaatcatcctcagcagcttgcagcggtgccgtatttaacatctgttcaagtgccgtgatcttataattcagattcggaatcgtctccataaagcccagtgctttcaggagaggaatcccaatgctgagggaaaggcagaggactaaaatcaaatcaggtaaagtgcttatgccacagagaacaaaccatgccccaagaggcaaagtcagaataacagtgcagggcagtagacttccgtatatcgccatccagggccaggcggccttataccatgccaaggtataatcccgatagtccgttacatccttgcggaagttctcgtaagattcactctcccggttgaaaaccttgacaacctccataccattgatgtactcaatgatcgtgttgttcattttctgtgcagactgatagtagggacccatgcgcttcattccaacagagtacataatgaccatggagagcaggctgatcgggatagaggccaaagacataagagccagtttccagtccgcacaaaacatagcaacataaatcatcagcgggatcagtaaatttgcgataccctccgggactgaatgagcaaggagcaattccaagctgtccacatcatcgacaaacagctttttgattgtccctgtccctttttcctccacaatgccaaggggaagtttctcaaacttcttttgcagagatacccgcagccggaacaatgtgttatatgctgctttatgagaaattgataatccccatccataaaaaaacgcctgcaaaacaagacagatcaaaacccctataacacggaataaaacaaattctgtttcaacagaatcgccaataaccaatggcgaaatgacctgataggccagcacaaaaggcaggatgcccataagaacgctgaccagtacgacaaccgtggccacatacatatttttcttatatggccctgcgtactcaaagatttttttgaacataagccctccttatattgagccgtactgtctgtgcttcaaaaacaagaggccgccaaagtaaagcggcctcttatcattatctttctgtccagtcaaggcggccctgacattcataatttctaaaattcactggcggattcggaaaaaatccaaaacctttttactgccggattcgtccaatggatagctttcttttacttgccctttttccatatggactacatacgaacatcccgccatcaccaactccggatcatgcgtaataacaagaagcgttttgccctgatccgcgagtgacttcaaactccgcgcaacttcccgcatatgtttgagatcaagcccgcttgttggttcgtcaaacacaatgatctcccggttactcacaatggcagacgcaatcgctacccgctgtttttgcccgccagaaagagaaagcgggtgcctgtctttatattccagcagatcaaactgtttaaggactttatccacaacagtttcatccttgttgtccatgctcagaagcacttcatccgccacgctttcggtaaatagctgatggctggtatcctgcattaccatgtagcaatgtttgagccgggctttccaatcaagggttttcccgtcaacctgcaaaaagccacacttcttttccagtccgcaaatacagcgggccagagtagattttccagcgccattcagaccgataatggcaatcgtttctccaacaggcagttctgcactcggaatatggagactttccggttcccgctttttatacgcaaagcaaaaattttgaaattccatatgtttagctgtatgcgcctgatactgattcgcaggcttcaacttcgagagagaaaacggccgcagccccatttcttttcgagtgccatccgataagctgtcaaattcagcaggcgtgtattcccgttcaatctccccatcttttacatacagcacacgatctgcaagatcgtgaaggtagtagaggcggtgttctgcaatcagaattgttttgccctgctttttccagaggctcaggacctgccgcaggtcatcaatagcagccatatccaaattagaagatggttcgtccaggaccataattcccggcagcaatacacttgatgaagcacaggctattttttgcttttcgcctccggacagagcaaacacgcttcgccccatcaaatcttcaatatgataatcggaaactgtccggtcaatccttttcaggatatcctcctgaggatagcctaaattttcacaagcaaaggctaattcactatccgtatccacgttgaaaaactgacttttgggattctggaatacagatcccaccatagcagccaattcataaagcggcgtatctgatacgctttttccgtccagaaggacatcgccctctaaattgccctcgtaataatgaggcaccagcccgtttaccaaacgggtaatcgttgttttcccacagccggattctcccgtgagtaaaacaaattcccctgtgtttatggtgagattgacatttctaatccctccgccgctggattcttcaccataagaaaaagaaacattttgaaaatctatcatggcaaaatccctcctgcggaaattatcggggaagcaatcgcccaaaacactacaaagcaacaaaacaagatcagaaccacatcggcaaaattgaatttaagctggcaaatgtttgtgcgtttgacaggagcgccgaggccacgggtaattgccgcagcggaaagttcctcaccgattttcacggagcaggtaatcatcgggatcagcttatactccaatatttttgaagattttttccctccaagtttaatcccacgcattttcatagcgtcactgattgcttctgactcctgaaagacagttggaaagaagcggaacatgaccgttaaggggatcgtcacttctttaggcatatggattctttccatgccggaaatcaattcactgaccgttgttgttttcactgcataggcagcaatcgcaacactgggaaggattcggcagaagaatccggttgtaaacagaacgaggaaattcaatatccccgtaaggtgcggcaaaacataaatttgaacagcataaaaagcagaaaacacagcaatatagcccacagcttttacacattgcttcgaggtaagcagcaatatagccggaaccgtacaaagagcaaggcggatcagccccatagcttctccgcctgttccgcccatgacaaaaatgcttatgatgaagatgagcaacagttttgtacgcggatcgagccgtaacccttgttctgtttttttgctgagcagaatttcccgcgccattatgcaataccggcacgctggaagtgctttttgcaaatggctttcccaatcatacctccgacaaggccaaacgcaaagcaggcaaccagcagaataggcgcaatccacataggcatatatgtattaagggtagctgcatattcagcgccgtatccttcagtcaacattaccatatagctttcacggttcaggaaaatgggagcaaagttgccaaacacccagatgctgaacacaccgcaggaaagaactgtactctttgcacttttgtagtccgcctttttcaggatcacgtcggccaacaggccgccaacgagaccagttaccatggtaagatagccgttgccgaagaacaccatgattaggccaatcaggaaacccatgattgcagtcatcccgaattttttagcctttgtaacatacagcatataggggatgccgccaatcaaagggcacagcaccgccatcagcggaataaaaatggggatgaagccaagcatcgccaccagcataacaatcacgacatagatgacggtgtagatgccgatagtaattaaatcttttccctcaagccgggaactttttttctgggaactcataccagtatcctccttatctctgagaaaatgaaaatgtggtgtggttagcttcttctaaccacaccacatataataacaatttgcacccacgattccaacccaaaaccaattttattctacccaaaatcagtatttttgcgtttatccaatcgtagcttctgctttatagtttttcggattcactccgtatttccttttgaacgccgctgcgaaattgctcgcttttgaatatcccaccagtatagccacctggctgacattcaaattactttctaacagcaggcttgccgccttttctaaccgctggtcgatgacatacgcatgaaccgatgttccgaacagggaggaaaagcccttcgtcaattttgaagtgctgatattgacctgccgcgccaattcctcgcagctcggagccagggcaagctggctgtcaataattcgctttgcctctatgatggaatctcggtcacttctggaaattgcaacgtaggttgacgcgagaatactcagctccaggacctcgctcaaatataccgatagcagctcaaagaccttgctttccagaaacaggtatcccaacccgccacgatattgcgtgaagtcttgcagctccgcaaaaatgtgttccatatagggcgtgatattcacctttgatatgccgtccaataattttttccgatagacctcgatctcaccagcctcaaagtagtcattcagaatcttatagaaataggatagaggtattttcacatttttgaaaaggaaatcgctctttttagaatagcacatatattccattttcccgtggccgcgataaatacaggattcacccttttgtatgctggcactttgccggttgtctgcaatattccaggaaacaccgtcattgaagcagaacagcatttgtatgtattcttcactgctcactccctgcacgttcatatccgaaaagtaattcattctccagtctgaaacaactgctccctgtttcgtgacgatctgcgaaatctgaccggttcccatgtctgccggaatatctatggtgatcgtctgcggtgaattagagagcagatcacgataaagattattcatgtattgatttgtcatgtatgagcgccctccttatggttagtcaatgctaatcatagtttacaacaccaacctggaaaagtcaatttgtattccttgtgtataccgcagaatccatttcacatcaaaacatcgtagataccacttcaatgctatttcaaaaacgtagtggcaattaatttacgaattatgcctactcatcgtacatttttatccttttgcattattatttctttgttcttattatcatttgcagcattatctctcaaataattttcaaatgcatctgcattatactgatactcctgcggttcagcgaccatcggtgaatatacaatctctgcttccactcgctcagcttctgccctctccggttccgtctgttcctgcaccttagcattctccatatgcttttccttatcaatctgcacattcatagccagattatccagcttatcaatcgaagcatccagatgaagctccattgttacaagcatctttttcacggctttcataggtgcaagcaccgcctttgtaatgggatgtttctgctctttctgtgaataatccacctccggcttgtcagcaaaagtgcggaatgcattgactgctgtctgccctgcttcacgaaatccttttgcaagaagtgctgtctttgctatatccttatccgtggtcttgattgcacctcttacattctctcggatatcaagaagttttttcttaatttctaagaactcagacaccctgtataatgcagctcttccctttgcctttgcttcatcaactatgctctttgctgtagatttgacctgtgctttcacttccaatacctgtgactttatctgctcacatctggcattgagtcgctcctgtgcttctgacaatgcctttttagcattattgacaagggtatcctcatgcatttctttaatctggttctgcatattggtgagttcttccgtcatggaatcaatctttttctccagtccatccacatagctgcatatctcaaatacatcgtttgcctgctctttcatggcattcttctttaataagtcgagaagttcccttataacctcctcattggtaagtgtttttcctgcttccatatccattctgtttcctccattctgtaaatggggcagccttggccgcccctgtaacatgattaccaattatcgaaagggcgttgcctctttgtccttctctttatcgggattgccatgatgtttctcggcactctccctcgccttttcgttgctcttatcctttgctttctcatattcaaagataatctcattgtagagtttttccctaaaatccttcgtgaccggataacagacatcctggtagattggcttgccctgctcatccacctgctttgtcttatatgagggcattgatacaaagattttctctttgccctgcacgatattgatgttatttacgatgaaactgttttcaaaataaatacgtgcaagtcccttgatgttactgccttccctctcataaggtgtcacagttacggaaaactcaggcatttcctgtgttctgtcctgcttctgtatctcctctttctccggttccttgattcttgcataagcatcaaggatattggtatagagttcctctcgaaattctgctgtgataggattgcacacatccttatagattacgccattgctttcatcacgctcattggagcggtatcttggcatggatacgaaaagttctcctttgtccttattctcaaggattgcgatattggtgatcttaaatgaatcaccgaataccactgttgcaaatcctttgatattgctgccctcttttgcccttacttcgtttaccttaattgaatacttcatatgctattcctcgctttctttttgttctttgttttgctccggtatgataaactcacaccaaagctgttctatctgttcacaagacaatctgccatttaaccagttgccaagtgtaacgaccattccgtcctgctcatagtagagccactcctgtgtttcaatgttcccctcatacacgatggtcacatcaaaatcaggcataaataatccttcctctgcatcccatacacaggctattccctgtctgagtgtcagattcaggctttcgacatacacagaccagccgcttacgactatctgaaattcatcatcaatctctgcaatatcatcctcgatgtcaattagctcttccatttctgctactgtctcttctatctctcctaaccggtatctcttattcatccatcaccgcctccttataaatgcatctgaccacaaaacgcatggttcctttttgggaacaggtaaaaagagttaattctttttctgtaccctgtatcttgatgctgttatcatacggatttactatctctgtctttgttacctcatagatatgcttcagcccctttttgtcggttatcatcacttcatcgcctatggatatctgacttagtggtgtaaaaaatgcgccatatctgctgccgttgtgaccgcacaatacacagttgccactctcaccgattcctgctgtttcttctatatgaccaatcccggcattaagtactttacttgtggttccctccattaccggatacctgatatctaagcccggtatctcaatgatgccgataacaccgccttctttaagaatggcttcatcctctttactaatggaggtttgctcttcctccacatctgtttcttcatcgtaatcatcctccaatgtctgctcaaattcacttatgagctgttctgtctgtttttctccggttgcccgccagaaaaaagggactgccataatggcaatccctgctgtaatcagtagtcctgcgaccacttttcttatgctcatattattcactctcctatcgtgttctgccctctctgtcggctgaataagtgcctttatcctcagctacaattgctgcagcttccatcctgtcatctgcttctctttcttcctccggtccgctcaggtctgcatccacagcctttgcgttctcaaggtcaagctgggcattcagttcacactgtcttgccagcttttcttccagctccgtgctgtatgcaaatggcttatcatactcagtctttgatgcttcaaggtcattctggtactgctcaatcttcttttctaagaaatcaatgttctcatggagtccattgaacaggttttcaagcttcaccatactgccgaccggactggtggaaagctctgctttatactctgtctttccacgaagcaccatataattgatgtcaaggaagttcttttccacaagcagctcaaatccatggaatttaccgattgcagttgtctctccggtcttacacttgctgattgcttcaagcatcatggttccaccatccacacgctcagtataagttgctttgcctatggtaatggcaaattctggattatcaatcagctccttatcccttgcctttacatcctcacggacattggcaagcttttctgttgctgtcttaatgagcttcgggtacttaatcataaagttgtcctgaagtccatatctctgattgtcataggatgcctttaagagctttaatctctggacatcattgtcaatctccatcttttccttgatcaaaggattaccggtggcaaccgccttaatctctgcataggaaagtgttgcctcgtcgatatcctcgcagcttcggcttaccgccttgcttgtcattacctgactgatgaatcgctgcttattctcaaccagcgaccagttgtatgcatcaaatgttcctttggtgacatatctgtagattgccacctcttcattttcgttgccctgtctgatacctcgtccttccctctgttcaatggaggaaggcttccaaggacagtccacatgatgcattgcaacaaggtgtgtctgcacattgacacctgttccacacttatctgttgaaccgataagaactttctttttacctgtcctcatctccttaaaaagtgcatccctctgtgcatctgtcttggcatcatggataaaagctatctcatctgccggaataccatactggataagagtttccttcagataatcatagatggtaaagtccttatccggtcccggtgtgccgatgtccgaaaaaataagctgacagcctatatgaccgttggcatttcctttctcatattccttccagacattttctgctaccttattgagctttccatcctgattgtttggtgcatccttatcaatcagtcttgcatctgttccgagaagtcttgcctcatgggtaatcttcaggaagttatccacgcttggatcaactccaccgcctctgatacgctctgctctcacaacaaagtcttccatgacctgctttacataccagtcaggctccgactccacaataataggcttaccgccacgaagagccggtacatcaaggtcaagcatgtctgcagtctgcacatcagctacttcacggaagatattcataagctccggcagattcgtaaacttattgaatctgctcttaaaacggaatccgcttccctctactgtaagctcaagtgctgttgtcacttcaccaaagttcgctgcccatgagtcaaagtgataaatccccatctcttcaagtgccgctttctgtaagtaaagctgcatgacatacatctcacacatggtattggatatcggtgtacctgtcgcaaatacaatgcctctgccatcatttatctctgatagatactggcatttaagctgcatatccgttgacttcttagctccgctactgctgatacctgacacattattcatcttggaaaaaattgcaaggttcttaaaattatgtgcctcgtctaccatgatagaatctacaccaagctcctcaaaggtaatgaggtcatccttcctgctctcatcagatagagatttcagctgttcctccagctttttcttctggctttccatctgttttacagtccatcgctctccgttacgctccttcatctcatcaatcgcatagctgatttcatcaatctgctcgttaagcattctctcctttctctctgctgagattggaattttctcaaactgcgagtgcgacatgatgatacagtcatagtcacctgttgcaatccttgatacgaactgcttcctgcggctcttttcaaaatcacgctctgtggcaaccaggatatttgctgacggataaagccttaaaaactctgatgcagtctgcccgataagtggctttggaacaaccatgattgtcttattggcaagtcctagtctcttctgctccatgcaggcagccatcatctcaaaggactttccggcaccgacacagtgtgcaagcagtgtgtttcctccaagaaggattctagccactgcatttttctggtgtggctttaactcaatcgccggattcattcccggaaactgtaagtgacttccgtcatactcacgcagacggatgttattgaatgtctcgttgtaatactccacatatttctgtcttcgctccggctctgcaaacagccattccttgaacttctccttgatcatgttctgcttttcccttgcaagcattgtctcattcttattgacttcgtaatgatatttgccatctccgtcatcaatcctgtccctgacggttacagtctttagattcagcgtatcctcaaaaatagaataagcatccatgcggcttgtaccataagtcttagtagctgccactgaatgcttatccatactcttattctcgatgaaccattccatgctcatcttatttaagtgtacctgaatgcctgtattgtaaaactggcttctgactgctcttgcacgccttggtgtattgagaagctcatagataaactgctcataatcaagcggctcaatccatgtcgtaccaatctttacatcaatatccgaggcttcaatccactccggctgcaccttttcaagtgctgccacattacctgcaaatctttctgcctgcggattgcctgtatccgctgccatagcctttgctacacgaagcttgtctctcacattgccggaaagatactcgtctgctgtctcccagccgatgtccggattattctcgttgtagcggtcgggatttaagaaaatcaatccatccagctcttccacaagaactgcccttctaagctctgccaaagcatcatcacttagcgttatctcatccgttgcctgtccggaattttctgcaagctcttcctttgcattagtaatatccggctcatagatagaaagcatataggcaagatttacatatccaaattcattgacggatacatttaatgcttccacagcagtctcaaccctgtctatgacagtctttgccttaatcgtctgcttataaaacatatccgcttttttcacctccccgtcttcatttacttcttcaagactacaaagaagtgggtaatcgctgtcatctcgaaatgctattctgtttgcttttgaagtaatggctccatactgctttacgaaggcatcatattttacattaagaagtctctgcttatcagaaagctcctcctcgctgcagccatccatttggatatcaatcagatctcttgttatctgtctgattttatcaaggcttctgattcgctcctcggcagtctgtgatacttcttttcttaccatctcggaattttccctgtaatagagctttccttcaaaaaatgtgtaagtgtagtttctcacatccggatcagcaggtataacctcctctgtctgctccgcctcatctgacactctctcaaaatctgtaatctgtgctttgatattactgatagctttgtttaatgcttcatacatattgaagttctcgtcattattcacacagactgtatatctgctgtcctgtccataaatccttgtatcatattccatagacccaagcatcatttcaggatgttctgcaaagtaagaattgaccgctatgccgttttctgtcataccaaggtgcacccaatccggctcaatatcaatctttcgctccctcttctgcagaaacagaatgtctgttgtcacctctgctcccgcatttgtcttgaatgcagtattaggaagccttaccgctcccacaagctcagccctctctgcaaggtactttctgatggtaggattggctttatcaagtgttcctttcgtggtaatcaccgcaaccatgcctcccggtctcacctgatcgagtgcttttgccatgaaataatcatgaatacggaaattatatttgttgtactttggatcaaataccttgtaatcaccaaatggcacatttccaacaaccacatcaaagaagttatccggatatgtggtattctcaaatcctgtgatactgatattggcattctgataaagctgctttgcaattcttcctgaaatgctgtcaagctccaccccatacagcttacttctctgcataggcgccggcatacttccaaagaagttaccgatacccatagatggctctaatacattgccgcctctgaaaccaaactggacaagtgccgagttcatgcacatggcaatctccggtgaagtgtaaaaggcattgtttactgttgccctagctgcaccgtattcctcatcagataaaaggtctttcagctctgcatattctttgctccagcctgcgttttcctcatcaaatgcctgtgacagtccgccccatccgacaaacttcgacagaactttctgttcctccggtgtggcaagcctgttttctgattcaatctgctttaaagtacggattgcatccatattccactggtatctggtcttgggaccgcctttttccatttcccagagattatagtggaagttgtgcttcgtctgcccggcaacattcttctcattttcaagactttctacttgctgtactggttcctgctttggtgtaaaatctacagtttcctgtgattctgtatcagcctgaatatcatccacagatactgataccacatcatctgaaactacatgtccattctcatcaatcttggtttcccagccattcgctattgctcttttcctggtttcaagacgattggcttttacactatcctcgatatcaaagaatctcttatagaccggattcatcttatccctgtcagccttctgctttgtctcctgataatacttcttctggtcttctccgcagtaaaatggctgttttaccatataggataaaatctcgtataactcacgccagtcgagagcaccttcctttcgcacaccattcctgttcttatagctgatcttcacatatccgcttctgattgagtactccacaagaccatacttattgttggaatatgcttttctttctgcattatctgtccctaatgcaatatccctgataaggtcaagtttattgggcataaatgcaaaatcagactgcaccacatccataaggaatgccctaaacggagtgtagcagctgcaatctgttacaagaatctccgccgcatcacgcaggtcttcatcaagctcatcaatacgcttggcataatcaatcggtgtaatatactgaagctctgatggatctttttcagttgtttcagcttctatctctgcaccatattctgcatgtgttaccatgcggtcttcatcggcagtttcctgtggtgtcatgccttttgcacttacataatctctgttagaagcatagctctccggctcatccggtattgcataatcatcaatctctgattctgcctcctccggttccacttcccggtattcggcatcaatgacctcatcatcctcacggagtccgtccatcgcaagctcatcaatacgaggtgtctcaggctggtattcccctgtaagaataaggacaccaagctctttttcgatatctttccatgaaacatatccttcaacctctccatcctcatctcgccactgaaaacgcagtccgttcccatgaaatgtgtcatatccgtgcagtcccagtccgtcaaccggccagcctgcacctccctgaccatattctgctttgatacgctttgctctggttcctgcatcaatctctgtttcaaaaatcttgcataccctgcccttaccaccgataaaacctgtacctctcataagcacctgtttgatatactcacttggtactgttggagactttttgggattcaggtaattgtatttacctgctaatgcagcttttctgtcctgctcgaactgacgcataaactgattattattttcatcctcagtatgaatggtgccaatgcttgcctgcccgttctggtcgaaaaaaaaggaagcctgtgtatattcggcttccttactaacacccaatgaattgatttcatcaagttccctattcagttctgtatcatctgattctagtggaatcgcatcactatctgatggagtaccacttcctctgcctgcatcttcgcctgctctcttatcttccacatctccattgtcgatgacggattctgtggcttgtgcttcgccagatactgcatctccagctggtcgtacaactggttcgcttcctcctctactgctgccatcttctcgtacatcttcccgaatctcatcagagtcttgtatcttgccggctcgttctcctgaagataactcatcgccatccttccgtacttgcccagcttcgtgagatcctccgtctcgtccggcatctctatctgcggataaagcagtccgtccacttccttgtaagtcattttttctaacatatccaattctcctttcgctctcgattgcctttaagttacgactaaattctctaagaacactacaggagacatcgcatacaatggaaccaagacggtaaatgatctcttcgtctttgatatttacgatctgactaaaatcctgttcttgcacagataagtcaaatccgcatctcgtccctacagcatacatgacacttgcatatacaagctgctccatgtccatttcctgctgtaagccattgcgtttcttactttcttcctttatcacactacctgatagctgcataagctcggtcattcggtctccgaactcttcttttattataagccaaacatctgttcctgtaaactgttttaatatattttttagagactccctgtcgctgttatcgtactgctcaatctgaccttctgacacaagaaaatccacataatccttaagattttctccctcaaggtcccatgtcagtttgacattcttccctccggtatcactgatatcaaagatatatctcatgcgtggattcagtgcccttgacgggaagatggcgcagcctttcgcaccacgctttacatatcttcccacctttttccaggtatcataatctgccatgagtgtgcttttttccggaggtctctgagctgttaccataacgatattgtcaaattcatagcggtataactgacctgcgacctttaacacatccttccagttcttttctgatctggtgatgttaccaatttcagaatcgtatatcgctttgaccttcatatcaacgcccatacctttgtcctcctctacttaaacatctctgcaaacaatcccttaaattgctttaactcatccttatccagctcgattgcaaattcattgtcgattgcctgtttttcgcatttatcctttttctttgcaatcttacgcaccacacgaagcagtacatagcactcttttgactttacaatgctctgtttaaaggtcagctcatcctcatcgactgacttctgcgtctgatagataatctcttttaacttatcattgataccatctacttcctcaagggaaataataacggatgccttagaagcacccgatctgtcccactccttatgaagttcctttactaaaaactccatgttcttaattactgttgttgaatcacttttcatcttgctcttcctccgttttcttttaatgaagaagggagctgaccttcgctgataggcgcaaaatcaactcccttcatgtcctctgctccaaggactatctgctctgcataatacatatccattgccttattgatggcatcgtcaatcgactctgcctttactttctgtactcgtgaaagcacttcttttatctcaacatcaaattcctgttccatatgatatcgcctcctgtaaaaatctcatcaccggctcttttcttcctttacctgtctttccttaaagcccttatcgtactttccatcttccagcctgtcgtaaaaacaatcctcttcaatcgttccgaaatcctcatacatctggtgaaggaagtcattctgcagcttctttggtacatcatcatcctttgacatatcctgataaaaatagaacttctgctttagctttgccctgtaatcatagatatcctctatcttttccggtgtgccatactctcttttatatgccttgaaattcgtggttgagagtgtggaaccaagataaatgccatgctcccacgctaccccgattgtggtattatcctttgaaggcttctcttccttcggataacgcttatactctgtcgcaccaagggcgattgtaagagaacctgacttcatatccatcaccacaagatttcttggtgataatgcttcaagcaccatgtaatcatggtcattgaagttatggaatgtctgtcccctttcaaataatctgtccacactttcataatgcaggttaaaatcatctacccagcccttatcggtcattccaatctccttaagctttgcaacacattcagaagaactggcttctttatcaaaccggaattccttggaatcgttataaaatccctgaagaaagtgtcccagctgaatatcatccagacagaatctcgcagataccgttacatttgctgccctgtaatactctgtgaagttatctgctttaccaagcgtccttccaagctgcaacaaattgtctgcaagctctgacatgtcatcaactgctataaaactcttataatcatccagagtcatcagcatatttgtctctgttcccctgtcgttttctgttaccagtatcatatcttttaaatccattcttacctccagtctcagagagagactatgccctctctgcaaatttcctgttatggtcttcctatcacaacaatctttcctgtgcttgccacatcccggtaaaccacaccaagactttcattaagtgcctctaccactttgccatttccgacatatactgccacatggctgatgttcttatatcttccattgcttgtaaaactataaaagataaggtctcccggctgtaactcatcaaaggagactgtctttccggcttcatccagtccctgtgcctccgctgccgctgtggttgcaccgccgaaactaatatccacgcctgcatccttccatgaataataggctaaggagctgcagtcataatagttaccgctgtctcttaaatcctgactataagggaagccaactctgtgaagtgcataggagcagactgttttctgcctgctgtctgtaattccactaaggatggcattgatttcatcctcagtcatggagcttactcccggacttccgcctccgccgccacttccgcttccggcatatccaagctgtcccataaactccggactcatgatctgctcaagcatttccacctgatcagaattaaatccatagaccgaaatcatatctctgtacgatttcagtgtgacattcacatacagaaccgacttcgtgacagtagttacattaccgtctgcatctgtttcttccacatcctttgttcctgtgcttgtggtgtatgaacacatatcatttactactgcctgcagccagccttttgaaatgtcattcatgactgttgcagtatctccgataccatgcttgaccatatagactgccatgatgtcatagtaattgcttgggttttcttccataccttcataatccacatatacaagctctccaaggtcatatccggtatgctcattcactttcgtattcacatcccggttaaactcctgcacataagcactcgttactgtctgcacggtatctcctgattcaagtggtggcagaaataaagcaaatggagaattgtaaaggattgctatcaccgctataaccggaacagcaatcatggcaactacaagaacaagtaacaacagcaccaatccgataatcggtgcagctgcctttacccaggtaatcgcttttcgcacaatcagatcctttaccagctttgccacgctatccgtctgattctcctgtgctttcatcttatctagaaagaactttatcttcctgctccggttggtcatcttttcatccttgacctctatggacacacctgcagcatatccggctgccatgccgattgcagttcctactcccggtgcaaccgctgttcctgccgctgtagcagctgtctttgtagcagtttttgttgcaaccttggcagtagtctttgctgtttcttttgccgtctctttagctacagtcttggcagtatctttggcagctttctttgctgtcttttttgccagcttctttcctgcctctaccttcttgatacgcttctttgcctcggctgccgcctttttcctgaaaagtgcagcccccttagaagcagttccggtaacagggcggcttgcttcatatgcaagatatgctgcctgcgatacctcctgcccgccttccatctgctctgttactgccccggctgcaagtgcacctgttcttcctgcaatgtgaagattggtattcttggtcttgattgaagttcctgactctctgatgttacgcttaaacttagaaagacctttatccttagcctccgactgatgaatggtactcttgcgataggacttctttttatcatcagatacctttgcgccgatagtcttaggacctctctctactgtatagatgttgctgcctttaatcttagctccctttggttcgtgggcatgaatcttggctttctccttggtgtgaatgatcatcggcttgtcatccactttctttatcttcaatgttctcaccttctttctctcaaaatgcaaaacagccacccagcttcccggatggctatgctttgaggtcgcaaattgcgacctctatcaacattattcgacattgttctgcatttcacgcttcttctgttctgcaatcttctcatgaatgttggtattatacagcctgtacaaatctgtatccttactaatctgattatcaaatggaatcaccacagagccacacttgataagccccattcccgatgcggtattggttacaaatctaagctgtgcctctgatactccaataacctctgccatcttggaactgtctgtattcgcctgctttaaaagtgccacaaactctgagtttgcaagcattgtagttgctgtgtaattctgcaacaaatcgacgacattctgcgtgataccggtacaaagacctccctgctttcttaccttcttccagagctgctgcaagtattttgcagaatactcggaattaagcaggacatggaactcatcaatatagagccatgttgccttgcctcgcttaccattctcaacaattctgttctgaatggactccatcataacaagcattgtgataggactaagctctgtacctaagtccctgataccatatactgtaaatctgttatccacatccacatttgtctggtgattgaagatatttagggaaccatttacaaaaagctctagtgacaatgcaatgtcctttgcctcgtcctccggctgtgccataaggatatcgtaaaaatcactcatcaccgggatatacttctctttgcttcttgcaatatcgatatacagctttctcacacagcggtcaatgattgacttctgtcttgaatttaagctgtccccgatacactgctcacaaagtccaagcatgaactcgcctttttctcttaccattcccttggaatcattcggatcaaggctccatacatccatctccagcggattcacatagttatccgtgtaagtagacatatttactacagttccaccataggtctcagcaatatcaaagtattcgttcattgggtctatgacgattatctcatcatctcccgacaagaatacgctgcccatctccatcttacagaagaaggatttaccggaacccggcactccgaaaacgaagccatttccgttgataagtttctttctgttgccgatattcacattcttgctgatctggttgataccatagtaattgcctgtgctgtcattaagctcctgcacattgaatggcataagcaccgcaagtgactgggtaagaagggtacgcattgtctccacctgtcttacaccaatcggaagcgctgtgttgattgcctccctctgctttaagtagtgtgtatcaatcgtgcagctgttacgctttccgatagtctccacagtctcacatacactctcaagctccttcttgctttctgccataagaataatggtaactcctacgaagaaaaggcactggtcattctcacggacatcatccatgatttcctcaatctcctttttctccgttctctttgcatatgagatttccgtagaaaaatcgttattcttattgcggactctctgctgcttaatgatatccgactcaataccaaggtatttcttctgaagcacctttgtagtcaaatcctttggcacaggcaccacatcaatgctcgtgatggaatgaaccggaagggaagtaatctcattgatgaatctgtctgataaactgctcggatactttttgataaaaagtgccttgcagaatttactctcatcctcaaaatggtccgggaaatatttcaccattccattacatagatcatttctaaaatctgccccgaccttcttagcctttttgatattaaaatcaaagctgccctcatctccaagatgataatagtcatagagcactttcagtctctcattgccattaagtggtacaatctctgcaccaagctcaatgaaagccttgtgtatcgttgcctcaagagttgcaaactgtgcctttgcctcctcgaagttctttctctcaatcgtgatcgtcaggtatctctcctgctcaatcccctgtctgccctcaataatcttctcttcaatgatgtcattgtagatacttctataattattgaagccatcgtttttctcagcaatcagaaccttatcacggagttcatccatgtttttgttcttattgttgatcgtaatcttataattacagtccagcgaatttaagaacttacagtatctctcgaaaataccgatctgctcatcctcggttgctgtcgtgtaattgatgtcctgaaagcggtagcatttggaatacttatttttgcttacttcaaaaatgccgttttcagccaccgccataatctctatggtttcctgaatggatttaggtgtcttatacaaaggctcactcgcctttttcagtaacttaaatccgtctgtaaataaacccatgtctctaacctcgctttcttataatgaaagcccgccgggaacttcaccctgcgggctgtgttcccgaccttgcggtcagatactattcgtttctaatgcattgccttatatgctgcaatgcctgctactgccgccacaatgactgcgacaagtccaagcagcatgtttctcgtctttttcttcattgcttcaaactcctcctgcttctttacagccgaatcagctgttacagtctccggttcagcctttctgcctttcttctttacctgttcattctgctctacttctaactgctttattgcaggctctccttctgttgatacataggtaagtgccttgtttccaaacataaaatgcagtttctttcccatatactcgtagaaattcatcccgttaaaggaatagaatccgccaagtgcaatcggtgccacacagggaattgccacataagcagaacccgtaagaccgatatacttgtaaagaagaaggacgataccgccaccgactactacgcttgcaatagaaaatataagctgccttgcagtaagtcccatcgcaaccgattcctgatagcggtcaatatccttgtttacttcgattaccattgtccctgcctcctatcttgataaatcctttgtctccggctttcttgtcattccaatattcgcctcatacttatccattccatccggacacagttctctaagcttatctacattgaacagataaagcggatattcgcagaaaccactcctttgcgtaaatcctgtaaactctccaaggtcgttatctgtaataaacttttcaatatccggcatgtcattcacattcagatatccgcagtaatttggtgctgcaaccgacaaattcacagtcacatccccaaaaggttcctcatatccatcttcattacacataagaccaataaacattgccctgttattcatatactgctggatatcaaatgtcacctgcgtttctccggttatacttgaattataagtaacctgtttcttttcattatccatttctacctccttctataatccaaatgccttgcttgtaagtgtctgtgcacccttcacgcttccaacagtcattgctatcgtaaatgtcatttcacacagatatataagcgtctgtgcccagtcagcataacttcctgtaaatgccggaagccctgcattgataaatgcattacataccacaatcgcaagtgccatcgttactgcctcaaacgcacacgaaagaaaatatttgcagtaggtagccattgtatgactgaccattctgtttcctgccatcgtggagcaggcaatcgcaccgagcggcacaataatcagtatctttaagaacctgaaatacactgtgtaaatgatgaaaaatccacagataataatgatgattgcaagcaaagctgtaagtatcagcattactagactttcaccaaatccaagttccttaatgatatctgcctgtgtactgtcaatagcaagctgtgtcgttgtcccggcagatataagtcctaccagatttcctatggaagtaaaaaacgctttcatgatcgtgacattatttgcaacaaaccattctgcaagtcccagtcggataagcatacgaaatatagactcaaacctcatctcatcttttacatctatgctttccgagcagaaaccgataacaaagaacagcacaacgagggatgaaccgaccgctacaaagaccggctcaataccctcaataactgcccaaggacctccgcccttgaaactgaccggtgactgtccaagcattgcaaagaccagggatatctgattgttccaaaacccaaacaccgcctcaagaagtgcaaggatcttgtctccaagcttaaaaatatccatacttgttattcacctctttccttttactaaaaggggaactttttcccccatcttagaagcctaagaatgtcagtactgttgaaataccagccatcatgacacctgctacaattcctttcagtgcagagttcatggtagatgaatcctgctgctggtaggcttgtgcgaactccataacattctttgcaagaataatgacaccaaccgcaccaatgactgcaatgataagtgtctttaaattctcaagcggctgtgttactgcggaagtacctgtacctgctgcaaaacaggtagtgctcataagcatcactcccataagtgctccggataatgccggaacgaatctcttttttaagtgaatgaatctactcttcatgcctttctcctccatctgattgttgtttgttgttgaaataacctgttcttttctcatgttgtttaatctccttttttgaagtgacagaagcggaaaaagccagaaaggaatacacatattccaatccggctagctttccgaacggaatatatgcattcctttctgtcctgttgatagttactctatgataatcaggcaatgcctgttgtactggttaatcgggctttccccgatgcgtttttgctgtgaccatctcctttcaaggtatgaaaaaaagcaccttaaccatatggctaaagtgctaatttactctcaaatttgctttattctaaaagcattccatcaattattgcaaactttgtcttaaatatagatctattctggcaatatcgtaatatgacatcctgtacataaggtcttgtacaataactgtctaccacaatctgtttatcttcctctttctctatcctcttaaatatgccttttgcattccaatccgtctttacagcatctactaaatcattactcatctcaagatgtgataaaatcgtggaattcaactcggtttctttaatttcagatatttgtccatagtcattaagttgcttcaattctctcttaattgcctccgtgtaacttgtcatattattatctcctatcaataagtattcaggtgttacatctagtgcctttgctagttgtaaaagattatacgcacttggctcttcattgagtctaccttgttcataacgtcgtatactctgaacagatatatttgttatcttacccagctcttcctgtgtatagtttcgtatattacgcaactcttttaatctatctgcaaaagtcttttccgtattcatcctgtacctccaatataaaataatttctgtcttttgtaactgctcacatgttagtagtccaataagctgaagcataccatgtgagcaaattatatcatatactctgtaatatatctaaaaacattactgcttctttcgatatgaactcatcttctccacagtaacctccggataaaagtaagtaagaatcgttgccttcggaactcctgccgcaagtgccttcttcacttcctctttctgctccggtgtatatgaccagtgcagcattcggtttgtgattgtatcctcccacttaggcttttccctctcaggattccttacaggcttagtaccagcacttccattagaagagttagcacattctgtagtatcagacttctgtgactcatcgacatactcaagctcatttgcctgctccctgtcaatctttgctttctgctctgcctcatcctgcatggagaatcttctgcttaactccgcatcaccaagcatcataaactgctcataggtaagagaatctatatacacattctcgcccttatccctcagcttttcataatacttaactgccttgtctgaaagaatctcaaatggcggaccgataagattatctgctcctcttatctgatgaacataaggctctcccttgccatctgctgtctggttaaacatcggatgattgaatggtatgaacttattatccatgataggatcaaatcctctaataaagataatgcactttttgttatctagttttcggacttcatccggtgtgaaaagttctcgacctaaaacatcataatttcttgaagagcttccctgtctgccctttgtctctccacttgacttcttatcaatcgtgccttttccaagcagctctgacacatacttgtgcgtactctgctcgtttccaccgagatagatgaaagtatcgcagttgccgggaattgtctcccaggtatctttgaaaagtgcctttaactgggcaaagttctgaatgataataatacttgaaatctcacggcttcgcattgtcgataacagggaacagaagtcatcgggcaatgcgacattcgcaaattcatctaacataaatgtcacatggattggcagccttccaccacaattaaagtctgcctgatagtacaattcctgaaatatctgcgtataaagcataccgataataaagttataagatttgtcactatccgggattacacaaaagagtgctgtctttgtctccccatctccgtttacaccaataccgatatcggacagattaagctcatctttggagagtaatcgtaaaacctgcttattttcaagaaatgcaagtcttgagttggcactgatgataatggaacggacggtatctcctgcacctctcatacatttgttgtactgcttgactgccagatgattggctccgagtggggaactttcctctaaaaacttcatacgcacatccagctttgatgccttcccctgctctgtaacctctgcctctccaagaagtttaagtactgtctcaaagtttctctttgccggctgtacctccagccacacataataaaagatagcctgtaagaacaatccttccgctttttcccaaaacggatcacttggtgtcgctccctttggtgtcgtattgctgataaggtttgtaatcagcttgaccacatctgtttcctctctgatataggaaaatggattgtaacagtctgatttatccatctctaacagattaatgactttcaggttatatccgttattttttaacatctgcccgcagcttctaaggatttatagcgataggtaaagctttgatgttatctccaccttttcccccgctctacaccgtacgtgaaactttcgcttcatacggcgtgccatcgtgcttttgtaaatcatagattatctatattgattggtaaccatagttacgtctgattttgttcagtctatttctttttgattcttctagcttcagctttgctaattggatttttgcttcattgatgttgtcattgaatatcaaattaaaaactcttggttctacaaatgcgatatttccatgcttattcgttccaccttgaatcagtggtattttccttatgcatttcatatcattggcatttaatttctgacctgttatataacaattcccttgttgaactacaaatgcagatatacgattatcattaaattcaacagattcattggggtctctgcctcttgcaagtgcttcaaattctaattcagtaactttttccagattgctatgaattttctctcttcctttagctgtgtaattcgttgtgtcttgtgagaaattcataggacttttgtgacgtaccgccgtaataggcagtaatgtctgtgaacctatttttacaatctttgtttcatctctgattccagttgcctttcgctgaaattcgatatctgtttccctaaatgggactgttttactgatatctcttagacgtattctaatggtcggtaaaagagcgtaactcacatccgttaagttgttataaacatttgttgcaatactgtaataattctgtatacctctcaccgctgaattataattctctatggctatatatgaggtatgcttttggatgttaataatcttagctttcaggttagttttggctttcctgattgccttgtcgctcatatctgtttttgcaataaatccgtatcttgttttcccttttggtacaaccttaatcttgaatcctaaatatgttgacgagtttttcttcatattgattactttggatttctctgggctgacatctagcttcaaccttgttttcaagaaatcaactgtagcataataccatctttgagcttcatcatatgtcctgcacataattttaaaatcatctgcatatctgactatgaatccatcttttaaattggtgtaatttcttgcataagaataaaaactctttttggatttgaatctttttggttggtatgtttcccattggtcacttacccaccaatccaattcattcaacactatcaaagacagtagcggactaataatgccaccttgtggcgttcctttcgtcggaattccttctccctctatctctgattttaggattttgctgataatacaaatcagccttttatctctgatacctaatgtccatatctgttttaataactttccgtggtcaacgttgtcgaaaaatccttttatatcaacatcaacgcaatagtaatgacgaaacatattaaccatactcacagctctgctaattgcatggtctgctcctctgttaggacggaatccataggaatgattatggaactttggttcacatattggctctaacacttgcagaatgcattgttggactagcctatcccatatacaaggaattcctagaggtcgctttttatcactacctggctttggaatgaacactcttcttactgattttggtttaaaatcatctaacatagttctaactgtatcaatgacttccttatctgtaagagttttaatatcttcaatggttttcccatcagttccagcagtattactaccactgtttgttttcagattacgatatgctaaacgaatattttcttctgaaccgataatctctagtaacttgtaaaaattgttaccatttttgctagctgcgtatagggaatcgaatactttttgcatatcatagtattcgttataacgtagcttggctttctttagcatggtctatatcctccaatctaggagtgagtacatctcttagtcttacacgaacccataccaattcgattttgatttactaattacacgactagaggtcttccctccaccacttattatcatggcttcataggtaccatacctccgctttcactgacataatctcccttatatcacttgcgtgattttcccgttcgatacgcttcacagaaagtaaattctccacgttgtcagcttccaacgttccgaacacattatctttaacatattacccttaggtttcttctatgagcctgctagcttgccattgcctttaacaatgcatggactttcataaaggcggagtcttactcacccacactagcgacactatttgtgtcactatgcatttctacatagtcccgatatagacccgtacattcgaagattcgtcagaagagtttgtctgctccccattctaaccatagataacttatagacctccggcatatcagacacaccgcccacctctgggtagctttcgtcagcctaactgttacggtgcctttctgccgacttcaccgagcttcttacatttcaatgtttactcattttcatgcaagtcggaggattaaggatgcctttcgaggcgttaccctgtcattcgacaattcatgtgttcagttctccagttgaactgaattctatataatttataattcagcgcaaactgtgccattgcttttcacaacggaacgttgcgcacctccctttggatcggtacagataaaggaacagttatgcggcatctgcatcagattcggctttacttcataaaatgtttttcctgctccggaaccaccacagataaggatatttccattgagcttgagtctcctgaaatccagcgacatcttcacattctggctgagtatccggttgaaattttcatccttatctgcaagtatcttgttgacctgcttcggattttcaaatcttgccgtaccaaattccttaccgggcatatagtttctctgactggtataatacatgacaatagccatcgcatagatacctaatgcaatggctactgcttttactgtattggaattgtaatagttggcaaagggaacagcacatacctcattgaatctgtccataaattcattaaaggcaatcccttccgtccacgcaccatttatcagataaccaagatacccggctaacactgcacccacaagaatgaatatcagtgaaggctttttctttgttgtctgcatgggctgctacctcgctttcttcgtggtaacagttttcttctgtgctgtctttttctgctgcttctgtactttctcgtaacgctccctgacagatgactccaccttgtcatagtgagtataaagctcggttcctttctgagttgtcaccacacgattctgctcatcgtaaagcttataatccttggttgaatcaaggaaggtaagcattgtctttccaccatgaatctccatgatgttttccttacggagccatacatattttgcctcttctccccatgtgccgggaactctggtcttaacagcatggtcattctcttctataatcagcttcttgctgatagtcacatctgacaggttcgcattctttgatgccgcaaccgccctcattctctcagcaaggtcctgatagcctctgacacggttgataaatgcatccttgtccatcatgactgtatgggtgccatcctcattcttactgccaagcacaccgattgtctcaagctgtctgataacactttcagcctgctcaccattgatactgaaattctccttgacctgatccacactgatagctttcttttccattgcaaacattccgaccttttcgatcagtccgtcaatggcagaatttaccttatccccttctatcgtgtggcttttctcgtttccctgctgtttcttcaaaaaatccatcagcttgccaagggatttttcatctccattcttcagataatcgtcaaatgtggcaatcttgccaaacttgagtttctgtatcatcatattcacacgtggaactgcctctgtatgaaagattacctcactcagtccgtctttcctgttgcagtccggaagtactgaatagagtattccatacttctttgccatcttttcaacctttttcatatcttcggtattaaactgtaacacctgtaaatcgccaccttttaagatcagctttctcatggatgtcttgccaagtgacttttcataatcaagcatcccttttaagaaatctattgccttctgcatggcagcaatgccgccgcttcctaccttcatggcaatctcaatgccatcataagctacacggatgatctgcaccgcttcctgaatctcttctgccattatcgcacctccactttctctctgactgttgttttaagcgtttctgtctctgtagtacggatttcctcggctgatacatcaataccataagcagtcaaaatatctgccagatgattgattgctttctcctcctcgacacgatacatttcaagtgccacaagcaggttttccacctgttccacccatgcaggcttcatatcatatttagccctgtatgtgaccataatctcgtccgactcagccttatccgctgaatgtgccaaagcttcaataagagaaatcgtgtcttccttgctgccgcttctgaatgcgaactggacaacaaagtttttctcttcctctgtaaattgatgctccacaccattcatctctgttactgcttcatttactactgctaaattcataagttcctcctaatctgccatgctgttttcaagcacagcaatctcaatgatctccttcatcttttccgctgaaatgttgttgtttataagctctacaagctgtgactcagtaagtcccttttctattgcactcttaatctgcacaagctgcgccggaacaaggtctcccgatgcaaccagctttacaatgtctgcccttgactttttcttaaatgacagtcttgcaaaaaggctcaccactccgctgttgttgctctttctcacacttctctcaatcggaagtctctgcaccacatttccagtaccatcaactaccggaatctgataatagaccggaatcccgtttgccacagcctgcatattctgaggaactgcaactgtatcaaccatctttttatctgcctgtgatacggactggctttcctgcggctctgccttactttctgcttcttttttattctctgtggcaacacttatgatcttatcttccaatgactctattctgtctcccatacgcttcatctccttatcctttttctcaatatcatccctgagtcttgcaatcgtactgcttgccttattcagttcattctgctgactgttgataagagcatccttatcctgattctccttgaccagacgctccctgacttcctcgtcatctttggacgtttctatttcagaaagcttcttattcaaggcatcatacctttcattctgatgatttatctttgcaaccacttcatccatctgagaaataagtgctttcacatactcagactcttccggaatctgtttcttgactttattcagctgttccagaacttcctcatataatcgtcgcatggtaataggtttttcccctttgtccataacctccttaattgtctgaacaggtacacccttttcataaaattcaagggacacctgcatctgatgaaccgaatacttggtattcttgataatatcaatcacatcttttggaacatccttgtgcagacattccgataaaatcttcatctgttcaatgtcgtatgacttattgagataaaggctgatctcctcctctttcagtccatattcataatcactttttacaagagcaatcgtatcttcactaaaatgcttatttcggagaagctgcaattttttctcgattgctatcgcactaagcggttctctgttttcttccatatatgcctcctaactactaaaaaaacagcctaacgttctggctgctctttcctgtctcgtattgtctctttgttgtactgtgcatcttttccatctgatacgctgtctggaataagactcttccatatagatttaccaatattcaactctttgaatactgccctttcttttgcacatgctttggaatactcctctttataatgtttacgcagtgcttccacctcttcaaggttatatccctgtgataaaagcttctgtttcaaagtttcccattgcagatgctcatccgtaaaaaattcatctccctggaggaaagacttctcagcaggttctaactctttcatatcatctgctatatcaaaaagttctcgacttctctccctagccttataaatgcggcttttctctgctgaaacttcttttcttttatctgtcaatgagctgattacactgacaagctcctctgctgaatgaatgtcatgatttacaaggaacaaatactcctcctgcagtttatgcatcttacggatatcatccttatacttccatacctgactgtatggcttctttttcagctttcctatccggtatagctttgcatagtatctcttttgaagccccgacatctttgcccttcggtatcttctcaccttacacttacaaagaaccggttgtacttctttctgctgttcccggtaaaatgaaatatcctctttttctatcctttcccggattacctcatcagaatacatgtcacctaatgtcttacatctgcgaaatctcgtcattccttgtggctttaccgccagatactttccctgcttgacctcatatcctttgtcagataacagctccagaaactgctcataatttcctgcctgcagtatgcaggaatccaggtctctcttaatcatatctgcccatacaaaactgccttcacgatattcgctccagtccttatagctttcatgctctttttccttactgccatcatcaacatcaatgatcgaaagaccatattcctgacacagcttattcgtgattggctggatatactttgcccagtctcctttttcatagcgatactttttcccatccacaaaactcacactgttaaatacaatgtgtgaatgaacatgtgctgtattatcatgcaccacatatactgcctcatatgattttccaagatactcttccacgaatctgcgggttatctcaaatgccgtatcaggattcacttcatcttccttaaatgagagaatgatatgatatccctgccttttatcaacttttccaaacttccgttttgtagctttcatctgttcaaaagcagaatcgacctgacagttgattgcaccaacgagccttccatcctgtgttttctccggattcatcacataatcaagagatctcttcagatgttttccgtgaaaatgcccaccacaatccttcatattaaggattttactgattgccaatctttaccaccgcctcatctaccttctgattcagttttcgcatataagctatcagctgtgtcttatcttccttggaatacagcccggcattattgttaaatactatctggttgatatttattccaattctgttgacttcattaatgagttccttcagaatcttccttacttccggataatcatttggtttctgactgataagaagacggatatactcagcctcattcattccattatcacatgccttttttgcaagcatcttggcttcctctggcattagtcttagtgttttcctaatacaatgaactttatctgccatagactcaccttcctctcttacccgtactataacccttaattccttctgcaactgtcaccgcagctttttccaaatcatccctgctacttagatggctaatgaatgattccaccaaagcagccgccatttcatcaatctcctttgcataacaggtcttttcaaacaacctgtccagcctcttttcatctgctttcaaactgtcatacttatcctgaaactcactgtaatctttaaaatcctttggatcattcctgtgtgcatcagcatcaagtatcagttcatagttccattcacaaacagtatctataacatcatctatcgggtatggttcaatttcaccattctcctcagctacatcctgtctgtacatcttcccatcagaatctatgccaatagcataatcatgaccttccatatagttaagcaatattgcagcatcttctatcgaagggttaagtaagatatcaaatgtgtctgcccaggcaatcagttcttctggttttgaaaatagcgtaacttctgcatccattgcttccttgcacctccttatccgtgtttagtaaatattcaccaaagctccagtctccagttagtccccggcgactgctagatacgcattagagacatctctgtcctaatgccatctagttagggagaaaatctccctaaaaccctctgtttatgaaagtgggggcgctttttgcccccactttgctactttgggggcgctttctgcccccactttgctattttgggggcgctttctgcccccacttttatatttactttcgtccggattttgtcgtgtccaaattgtgggggcactttttgcccccactttgacattttgggggcgctttctgcccccactttgctgttttgggggcgctttctgcccccacacatcaaaatccgatttctcatgccctgactggttcatctgctctctgattcatcttgttcagattaagctttgccgctacaagccactcgttgtaatccttatatccggcaggtggcggacagtcttctacctcatatccaagctcataatactttctcataagttcagctgctgcttttctccccggctcatctccatcaaggcagaaccggattgaagtaatctgcggatgttcccgaagaaaagtctcaagtggggcatctgcaagcatcccaagtgccagtttattcgattcgtaatctgtgaaaatatccacataactcataaggtcgattgcagcctcaaatactacaagctctgtactgttttcatttaccacattaaatccatagttcttatcattgcctatgacatcacacttgaatggcttgccctgcttatcaaacactccacgcatacttgcaaaccttgtcactccattcttatcgtttcccttgaaaacaacattatggtaatgcctgctctcataaatcagtctttcttttaaaaacagatctatgactgccctgctgattcctctctcctgattcagatatgaaataagataggaattatctcctgccggtcctggtagtacaaacggctttctctcatcagcctgctttttcgctacctgatgaacaagaggctgctttacaggcttctcaattcttctgtaccctgcaaaatctaaaagccagaacacagcctcttttacactcattccacaaaatacccgtaagaaatctatctgtgagccgccattgttgcctttgtcaaactgccttgaccatctgtaccaatggcttctgttatagatacggatggaatccatctcctttaaagtgtggtatttgccaatcctctttactgtatacccaaggctttcagcaactgcacacaggtcaacactctttgctatggcaagctcttcatccgtaaatcttccatccatgctttcaccttgcctttccctgctctgctacaagcggtgacttgatatcaagtgtccgataatcagtgctcagggtaatcttaggattatcaatcatgcctttttccctgaaactgaaaaattcacgattgtctccaccaactatgatatggtcaatgagcggtattcccatcaactcacacagcttgttcatgcggtccgtcatcatcgtgtctgccttgcttgggaatacgttcccggatggatgacaatgaattaacatcatgcttgcagcattgcttaagatacttgatttaaacagttctctcggatgtgccattgcctcatttaaagagccgacacttgcaaaatgcacattgataggtttcaaatctgaccttagattgaccacacacactacttccctgtcaaactggcacatacagtctcccatgacagcagctatatccgccggattgttaaaggtgtgctccgaataaatcggagcatcctttacaagtcttaccgaaaccacatcgagcttgaagtcattcttctttggcatcagacaccgcctcctctccaaactcgacacggataacaaagtcacctttctggctgtttatgagagcaatgagttcttccattgtaagttcctgctccataactgcctcctatctagacttttccttcgcatcatatacaaggggaggttctgcaacgataccatcaagcctcttgttcggtgtatcagttgcaagggtgagttttcttaaatccttatcatagtgatatacctgattggaaagtctctcgtccaaagacacctcctgcatatttacctcgactaccatctgtgcaagcatctcagggcttcccatatctgaagatactgcaataacctcatgcacgctcgaagggagaatataaaggtcactctctaaactctctgccagctcatgaagctcattctcataaagcatggatgctgcaccattgatacccttttcattggaaatcacccacatcgtctgttccggtgggatctcagatatcatcatctctgcaatctcctgtggcatcccatcccttgcgaacatttctcttataatgtcattcatgctacgaacgacaggcgggaagagtcttctcgtgttttccgctgcacacttaaagagctgttcctcactcattccaagtctttttgcaaattcatttgtaatttttgaactctgcaccgcatccttatcggcactgataatcaccttgtacacaatagaaagatcctggaactccctgtgaggcacctgttccaaaaatgttttattctgctctgtattgatgagctggaatacaatcttctcgtttgcatccctgataatgctgtccacatcaacaaccggagcctgctcatatgccctttccataaagtcacatgcagccataagtgtttcctcaagatcactacagtcctgatacttcttatacatgtcattgatataaatcgtaggcgaaatattccttccttcttctcttaagatgatgccatcaagagtcacattcaccttttccacgggttctgccacaagctccattcctttgaacttctctggcatataatccataaacttttcttttactacttccttaaaaatctcgtaattcatcatattacggttcctccttaatctaaattgtcatataaaattccttcatcatcgggattattgtgttctctgtaactgttgtcttcttcgattcccctatcaaaaatggtatgagattttcttttctttctgtaataattcttgagaaacatgcactttctacagttctcacagaataattcttctggcggaataccaagtgcctttgcaatcctgttcaacgttcccgtctttggaactcttgaaccattttcgtattgggcaattcttacatcacctctattttcaaaaccacttttctcgcccagttccctgagtgtcattttttgtcgttttctgtaatatctgattctttctcctaccactgcttgtcctccaaatcaaaaaagcggagaacataagtcactggcttacattccccacaaggttaattgttactgtttattctttttctttcttccacgaagtccgactccaacacctgtaataagtgcaagtgcaccgattccaagataaagaagcggatttgcattgtcgcctgtctgtggaagcttaggctctgtcggtacattggcaagcttaagagttgctacaacaacatccggtgcattgtcatcatatcgaagagttacatcgtgagctgtttcatcaaggatatatccgtcagctgcttttgtctcaactactgtataatggatatcttccttaaatgaaccatcctcattgtaagtacagataggaagctccttgctctctgcatgaccattcttgtcagtagtgagtgtatcaagcacctttccgtccttatcccttacttcaaatacaacaccctcgatcggctttccggttactttgtcagttttctcaatgacaatcttaccgactgcctgctcatccttcatggataccttctggatttctgctgtctcctttacttcaaaggttacatcacttgccaccttatatccatatggtgcagattcctctctgagtgtgtactttccgacaggaagtctctcaatcatatgagtctttcctgcctctgatgtccagctctcaacaagctttccatcagcatcaataaccgaaagctttgctccaggcaattctttcttgcctgtgatatcagtctttgaaatttctaccttgatcggtgcattttcaaatgctgccttaaactcgataacctttaccttatctccctgatatgaagcatccacatcaaaaatcttatcagacttcacatagccctttggtgcctcaatctctttgacataatactgtccaagcggaaggtcagaggtaaatgttactttgccatcctttccagtaacacctctctcaatctgtgtatctgctttgacaatgacttttccatctttatttacgatatcctctttcgcaaataagccgaatactgcaccttcaagagcattcttcgtctctgaatcagtctttgtgacagtaatctgcaccttctgtctctcattggttacatccattcccgcaaatacaacctttgtattctggtcgatataagaaaggtctgcatcaatcggtgtatcatccagcacaaatccatctaatgtctttgtctctacaagataatacttgccaagtggaaggtcatcaattcttgcaatgcccttatcgttcgtaacaatggttgctaccttgtcaccagctttgtggtatacagttccaagtccgtctgcacttacgatatcctcttttgcatatacatcaaaggttactcctgcgagactatccttgaagtaattgaaaatgaaatcataccagtgtcccttcataagagtggtatctgttacaaactcaccatccttgttgattacgatagaacctgtcggaacctcgtccttcatctcgacatgctgcacatcgcctgtatcctctactgtaaactgaatatcggttgctttcaggtatccgtatggagcaaactcctcacgaagtgtgtaagtctctcctacgacaagtttcttgatcacatgtgcttccttggcatcagatgtccaagtgtctaccacatttccatccttatcaagtacagtaagtgttgcacctgtaagctctgcaccacttgtgatatctgtctttgtaaactcaaaggttgtaggagtgtttttatactcgctgttatatacagcagtcttaacatcctgtccctgatattttgtatcaaagtttactgcttcctcatttgtcacatatccggctggctttacaagctcccttgcaacatattttgcgaatggataatccttaacaaaagcaatctttccattctcatcagatgttgccttctcaagaagtgtgcctttctcgataataactctgccatcagcattcttgatatcctcatctgcataaagaccaaatactgcacctgcaatcggtgtgttatcttctgcatcaagcttagtcactgacatatcaagcttctgtctgtcatctgagaaagtaaggctttccttgataacaggtgtcttatcatccacatatgtgaatgtcactttctgctcattcggatttaatacatatccgtatggagcttccacttccacaactctgtactgtccaagaggaagattcttagctgttgcctttccatccttacctgttgtaagagttgtcacaaggtctcccttgctgtaatacttaatgcggtttccgtctgcatccttctggttgtctgctgtgtaaatatcctcggcagcataaactttgaattttgctccggcaagtgagccttccttataaacaaactctttctcatatgagcttgcaagaagtccacccttgaatccgtcaagtacctctcccttcttttctacagtcagctctccgactgcaggggcatcggaatattccactgtgatgatggcatcatttgtatcaccatctgtctcaaatgctgtgtcagtatcaacagaaatgttgacatacttatcatttacaacatatccaaatggtgcagacacttcctcaatgcggtagttaccgattttaagtgcttccggtaagattaaatctccgtcctcatcagtaaagaatgaagtatgctctacctttgacggataagttgtgtactgctttacatattcgttcttatcaatattaaagatcttaaactctgcgtttggtacaagtactgtctgctttgtatcggaatccttcttgattacacgaagctttgctgtaaactctctgtccaagaaaactctccatgtctgaggctctgttggatgattctcctttatctttacctcaaatggcttgattgtcttcatgttatgcggagtctttgattcaactaccacataagttccataaggaattgcaatggaaactgcatgtcccttatcatcggatgtgattgttgttgctccgttttccccgattaccacaggagtagccttatcaaagtcataacttccatctgcctttacggataaagaagattttaagtatgctgtgaactctgcacctgcaagcagtcctgcttcagtatcatcgccattgtcagataccttgataagctggaatggctgcttgatgacctgctctgctgaggttgtgcttcttgatacctctgctactaagtcgccctcgtagtcgcataccacatcatgctcctcttcgtctaagagatacccttctgatggagtaatctcttttacataatagtttccaaggtaaagattattaacctctgcttcgccattcttatctgttgtaagtgttgctacaaggtctcctgccttgaatacgactcctgttgctccgtccggatgcacgatatcgtttctcgcataaagaccataaactgcaccttcaaggcttgcatctccctgggctgctgccttgcctgattccttgtctaccttgtagatatgaatctttgctgtggttctgtcatttacaaatgtgtaactgaatgatgcctttgcctgtgtttcaggtaatacattgaaattgaagctgtaaacatctttactgtttctgatatacgcatatggtgcctgtgtctcttggatataatatccgttagagattggcagatccacgctgtagcttgcctttccgtcctcacctgtagttactgtctcaagagctgtaccctttgtgacgataacctgtccggcatagtttttgatgtcatttccggcataaagtgtgtacttgccaccatcaagagggttctctgtgtcagagtccttctttacgacagatacatccgctttctgtcttgtattctcaatcgtagttgattcatactgtactgtcacagtctggtccttatactcaactgctactgtctgaggtgtggtattgattgtatacccgtcaatgctcttaatctcagttaccacataagttccaagatgaaggtcagataataccacctgtccgtcagttcctgttgtaaggctttctgccacaacatcgccagcactatacacctttgtaccatctgccttatagatatctgctccggcagttaccttaaaggttgctccggaaagcttctttttctcataagtgaaattgcttccattccatgagctaagcacctcaccctctttatagattgtgattgctccaagctgctctttatctgttgcagagattcccgttgtctgtcctgcttttacagtaagtgtatgaactgtaccggaaaggacatatccctttggtgcggtaatctcttttacataataagtgcctgcgacaagtgcagctgactttgcatatccgtttccatctgttgtcatggtctgtactctgtttgtgcatccgctgtcagaatagattccatagactgcaccggaaagcttcactccgcttgactcatctgtctttgtaagttcaccatatccgatgttctctgtcttgaccttgatatatgctttgacaggatctgctgtcggtctttcagaaataaactcctgatatccgctctttcctgtaagccagaatacacagcttgatgttgtctcaaccttgccagcattggatgtgaatgttcctgttgtagctgtagtattcacgctcattgaagagattgtaatactgttgccattcttatcaacagaatatccgctgatgccaaaatcaaaatccgataaaacaccattgctgtcagataatgttgtttcaaatctctgacttccctcattccactttaattcataagttggtgcctcactggttctgcgtgatgcaaaacttggaagcgttgcattgtaggaactgctgatattgtctctgagcctctcataatagctgtatgaagaatcaggacttggtgctgtgttacagagctttcttgctgctgaatcaccacttccagttccaaagatatctgctacaataacccataccattgcctgtgttgcgatatattcatcacactggctgttgcttggtgccgccttttgtgtactgttaaacccataataaaggcagtaacttaaaagctttctctgctgtgctgacattgatgtgctcgcatcatcgtagctgttcataagctgaccgccatctgctcttaatccgaaattcatacaatatgcagaatttccgtcaagaattgaatacagaatcttgccatgattatatccgggcttcagctcacttacttctccggaatttttgactgacgcattccagaacgcaatatttgcctgcggactggctgcaaatgctgttgttccattcgtaaagagtgttccaaccagtgtgagcatagccataaatcctgccataaaacgctttagtttctgtttcatgtgctctttcctccttaatttacgcataaaaaagaaagacataagtttatggcttacatctttcttccttctgcttctattcgtttttatttatctgtgacatcgaaactcgtaatagtctgtgccgcctgtcgtgtaaactccatcataactgatgtagaataccggatctgtttccaaaagtaacatacttgcaatatattctgcgattgcatcctcagatgataaccgctgtccatcaatggtacttgctttgttgaggtctgtctctacaaacacactataataagagccttccataccatcgtaaggataatactcattgtactcttcctgcgtgatactgccgtcattcaaatgattctgtaaattctgctgtgtggtaatcatccctcctgcctgacactttgctgttgcaagtgacacaacattctgtggactgtacgccacggatgcaggctgtgaattgctcacattgtctttcggactgtctgtagtctgaccaccattacctgcattactctgatttccgccagcttcctcattatcatttacagaagctttctgttccggctcgtcattctgctttggcttttcttcctgccttgaagcagtttcattatcagtggaccggttatcttccttatcagtcttctcttctgaatctttaacctcggcaatatctttctctgtctcttcacttccagcttcggttgtgacctctgtgacagcttccattgccattgctacttcttcagttggctttacgctttccgtttgtttctctgtctgattatcagccttttccttaccaccattacaggcagccattgaaaagaccagtactgcggataataagataatacttatcttcttcatagtaatcacccatcccttctccgcaagagggacgggctttgtgttccgtgccatccacccttgcggtgaactatttatctgtaatgcacgggacacataggactgtcccgtattctgtgcatcttaaactcctttcattataccagctctcttattttaaagaaatactgcataagtcttctgtttttcttgtaatttaagaataaaccctttacctgcatacgctcacctcctctcagaatgtgcccattcttacgaatgaaagaaatatccttgccaccatagcgaatagaagaagaattatcctggcaagtcctaagaccagcttcaacgctccaagaattatccttaatatccacttgagtatctctaaaattactgttcctacggctcccataactcttctcataataatcagtctcctttcgacatccatcccattgcaagtcctgcaacatctgcatcgtccataacatcttctgtaggttcttgtgcttcactattggctgcctgcattattaccggctgaccaacattcatcccggatatcactccgcctaacagccttatgacctctttcctagcctcattggttgctgcttcaatgacttcttccttaatgtcatcaatatcttctgaccggatatattcagccctctctttttccttcttcttgataacaaaagtttcttttccataattatcaatgtaaaactgaatcgcatctataatgaactggttcttagatttgaaaatcttcggatcaaggttctgaatcacatcattgattttcacatgctgaggattgctcatgttgaggcggacagaagtttttacttcatattcaagtcttcttcccatcatctgcctccttatgataatcgcttagtgcttttaagtcccattgtggcaagctgctcatatcctcttgcatttgcctttacatcaaggttataggaaatgttcttagcatcatgactaccaaaattcttcatcacaactgccccgcctccgacaaatacaatcggtgtagtctttaagttatacccaaactcacggattgagttatataccttatcaacaaaatcctctatctctgccttaataatggcaaagtattcatcatcaatatctgacctgccatatcgcatgatgttctgtatctctgactcgtctacctctccgttaagttgtcttacacactgttcattgatagaacgcatacaggtaataagaccttttggtatcgtcacacactttgattcatccggtgacttgttgattaccggcataatgtcgattgtccagctaccgatatctactatcagcgttttctttgccattgtaggaatcttgtccactactgctgcataacactgagggaatactgccacatcatcaatttcaatataatacggctcattctcatatttgaagcttacacgcttattctttgtcaggtacttaataaaatcattcttctctgctccaaaccttgtaagtggaagtcctactgcaaggaatacctttgcctctgcaagacctcttcttttaagttccttagcaactgctgcaagagtgagaagataaaagctgtcatcttcgacctttgtatcctttacttcctgcctcacagttccaaccttatagaactttccttcatactcaagtacatcgccgaaaagtgccggagttgttgtaatctccttaactcctgtaacaaatacctgagagattgttttcatcattgaccaaccatgatcaatgccgattacttctaacttgttattcatatgttttgcacatcctttcttcttaaacagccacttgaacatcttaaccacctactttcctatcagctttcgcatacaaggaaaacaataaccattcccttgataatatggacatccgacacattccgtcggaagtttctgttcttttttcttagatggtttacaacatgttccattggcacatctgttgttatgtccccagaagaatctacaatgcatacaatcttttaattctctttcaagcttttcttctggagatacaaacctgcgtttcttatgcttatctcttttttcaactgttcccaccagagctctcctcccttccaaggagtgattgctctcttatctgttccattgtcctgtccgactctcctgccgtcctagctaacgaatacaatacgataagaacaataattattaatgctatgctaaatcccatcaccactttatcctccttcaaattagttgccatatagacagaatttgaatttggaagtgatatagtctacatggctatgcttaacgctaagcatgtaggtacacgccagtcttctagactcctatatcgccccgtgtacaaagaggtgttctcacctccgggagttacagacgagccacaaaatgtgtttcacgacgcccttctgaattatcagaagcactatctcctcttttagccttttgaggataaggacaaacttctcgccctctgtggttgattatccttacgcaacatgccggtctacgcttcgcttcggtccgcgcagagcagagatccaccggatctcttgcgcccttttaccagatttccatccaacttctcacccttcatctttcgatccatcaggctactaatatgatagctgtgactttcatcttccaggtacatgccccgtaaatttactacctacagatactctgcagtgcaaactactttgcaaatctgtaactgattattaaattgttcatcccaagtttttcttggaatgtccatatattacattagtttctataatgccgaaagtgacaatcacgggtcttttttatcaaaacaggtactattgtggtcttttttatcttcgcttgacaatttattccaaatatgtttgggcaatggtcttgttggttccttaaatttttccaaatacatctcaaagatatcagtgttaatcaacgctgaatttccaaccttatacactgcccctgcttcagaagccaaaaccataatccttgatttacttatgccataaataatggcaccctcagtagcatttacatattttttcataatgtcttttgtatctgaatagaacttatatgagttactcattcaattcaccttcttcctgcccatataacggctctttcaaaggtcttgcaggttgtctgaattgctccatataattatcaaatatttccaaattgattaacacagtcccccctgttccctcatttattttatatgttgcacctgctgctctagccaactcgataaatctatgtctgccaatactgtatataattgaagcttctccaattctcgcaaactttttaattatctgcttatttgttcccggcactttatatatgtgtttcataaactcatcaaacctttccttttttaccaaatgaatacgggtaagcttgtataaagaacttgcagccttagctatatattcagtttcctcaacactaaatccatattcataagccacctcttcgacctttatgtatctttttattacctccccaccatgaagataagccctaacatctggctgtaattgtgttaccatccttttcacctacttataaaattcatcatcaactatatggaatgtctcaaggtactcatcaaatattattaaattcacaagtactaactgacctaacttatagattgctttggcatccttagccatttgcataaactttgatacgcccatatgatacatttctgctccttcgctatatcttacaaactttgtattaccattcttcttaaattcctgatatgcctttgtgtgttccatgctattctcctttcggtatttcaattgttcctataacgcaaaaagaggacatcttctaaatttctttagaaaatgtcctctaagtaatacaatctttaatttttcagactaagcaatctgtactaacctgtactaatctttttttgactatgccaaaaattggtcaaatcttagtcaaaaccccttgaccaactatatattttagtacatccaagtgctgaaacccttgattttcctgcattcttacttatcaatagacttcattgtcgggaacaataatacgtccctgattgcctggctatctgtcagaagcattacaagacggtcgattccgtatccgattccacctgttggcggcataccgatttcaagtgcgttgaggaagtcctcatcagtgtgctccgcctcatcatcgcctgctgctgcgttggcatcctgtgctgcgaaacgctcacgctggtcgattgggtcgttgagctctgagtatgcgttacacatctcccatgtattacagaacagctcaaaacgctctacctttgtagggtcgcttggtttcttcttggtgagaggtgatatctcgattgggtgatccatgatgaatgttggctggataagctctttctcgcagtactcctcgaagaagaggtttacgatgtcacccttcttgtggcgctcctcgtactcgatatgatgctcgtctgcaagcttctttgcggctgcatcatcaggtacctggtcgaagtcaacacctgcgtatttcttgattgcgtctatcattgtcattcttgcgaatggctttccaaggtcgatctccacgccgttgtatgagatttttgtcgaaccgcatactttctcagcgaggtaacggaacattgactctgtcagctccatcatgccctcgtagtctgtgtatgcctgataaagctccataagtgtgaactcagggttgtgacgtgtatctacaccctcgttacggaaaactcgtccgatctcgtatactcgctcaagtcctccgacgatgagtctctttaagtaaagctcaagggaaatacgaagctttacatcctcgttcaatgcgttgtagtgtgtctcgaatggtcttgctgcggcaccacctgcgtttgagacaagcataggtgtctcaacctccatgaaatcacggtctgcaaggaagttacggatttccttgagtatctgtgagcgcttgataaatacctctttgctctcctgattcatgataaggtctacatatctctgacgatatctggtgtctgtgtctgtcagtccatggaacttctccgggagtatctggagtgattttgaaagcagtgttatctcctctgcatggattgagatttcgcctgtctttgttctgaaggcgaagccctttacaccgtagatatcaccgatgtctgacttcttgaagtctgcgtatgagtcttctccgatattgtcccttgccacatatacctggatattgccctttaagtcctgaatattgcagaaagaagccttacccatgacacgcttgaacatcatacgtcctgcgatgcttacctcgattggctttgcatccatgatttctcttctctcattgtaatcgttgttgattacctctcgctttgcagcgtcatccaagccctctacatccggagcctttctgtcaccgagaatctcagcctcatgcgcattgtaaagctcctttacatcgctgctgtgatgagtgacatcgtactttgtaatctggaagggatcctttcctgcttcctgtaaattctgtaatttttcacggcggaccttaaggagctggtttacgtcctgctgctgtccacccttgttattattctgatttgccattttttacctcttttagttctcttctgctctctggatctcgagtaccttgtatgtgagctctcctacctgagtctcaacagttacagtatctccgactttctttccaagaagagctttacctacaggtgactcgtttgaaatcttgccctttaagctgtttgcctctgttgaaccaacaattttgtactcaagctcctcatcaaactcacaatctaagatgcggatcttacatccgatagaaatcttgtcaaggtcaacctcctcctcaacaacaacctctgcatttttaaggattttctcgatttcctcaatacgagcctcgatatcgcgctgctcatccttagctgcatcatactcagcattctcagataaatcaccctgctcacgagcctccttgatcttctgggaaacctctttacgcttaacaacctttaaatgctcaagctcatcctcgagcttcttaagacctgcatatgtcagaatatttttcttgttatccatgattcttacccttctatcttccttttttttatttttgatatttattgtactcatttagtatattaacttcccacaccaaggtcttcaataccggaaagtatacagtatgttccgaagaaaaatatgaactgccacggagtcccattacacccggcaacggaaacccggtagcaaagaaaccccctctatccgcgattcgcacccgtggctaacttcatatttttctgaggaatatactgtatgctatgccggtaacttcgataaactgaatgtgggaagtttcacatactaaatttaaagcctattttaacgcgtgtattataattgaaaatccccactctgtcaaggatttgaccgatttcaatttcgaagcttctacttatacaaaagcttctcaagctgttctaagctctccaccgtattcactgccgcgcgcagccttgatgaatgcggatatcctgccgtataccacgctgtgtgctttctcatctcgtgtattcccgtgtactcgcccttgaactctatcatcatgcgtgcatggcgcagtatcatccggcgtacttcctcaaatgatggcttttcctgatgctcgccggtctcaaagtaatgcagtatctgtgagaaaatccatggattgccctgcgctcccctggctatcataaagccgtcgcagcctgtctgctcctgcatttttatgacatcctctgcgcaaagcaggtctccgtttcctatgaccggtattgagacagcctcttttacctgccttatgatgtcccagtcggctttaccggagtagtactgctctctggtcctgccatgcactgcgactgcacttgcgccgctttcttcagccacatgtgccagctctactgcgttgatatgctcatcatcgaagccctttcgtatttttacggtgaccggcttatctatcgcttttactatgctctctataatctgacctgcaagaatcggatttttcatgagtgctgagccctcaccgttgtttacgattttgggcaccggacagcccatgttgatatccagtatgtcaaacggtctttcctctatctgctttgctatctgagccattatctgcgggtctgagccaaacatctggagtgaaacaggcttttctctttcatctattgaaagtagcgactctgtatttttgtttttgtacaaaattgccttggcgctgaccatttccatacataaaaggccggctccctgctccttgcacaataagcgaaatggcaggtctgtcacgcctgccataggtcccagtatcaggttgtttgggagtgtcacacttcctatctgaagctttcgtatctgatgaatatccatactattacttcactcccttgcggttctgcttgcgatacacgaggtttatgccctttaatgtcagatccggatcgtatacatccacgttttctgtctcattggatattattctgccgagtccgccggtcactacaacctttgcatcgtacatgcctgtttcttcctttaccttgttgatgatgtactctgtctgtcctatctgtccatacacaagtcccgcctgcatgctggtgatggtatcctttccgaggatattatcaggctttttaatctctatctcaggaagctttgctgcatcctcccagagtgccttggcagagatacgtatgcccggtgctgtgattcctcccatgaaggtaccgttttcatcgaccatatcgtaggttgttgctgtgccaaaatctatgaccaaaacaggtcctccatataattcatatgcagctacggcgtctactatacggtctgcgccaatttgctgcggatttggtgtggcgatacggatgcctgttttgatgcccgcctccacgattatcggcctgatattaaagtattttatgaggccattctgcagtgaatgcatgatattcggtacaacggagcagatgattgcatcatgtatgtcgtccatgcctacctgatttctttcaagcagagtgctcagaagcatgccgtattcatccgatgtacgtggcattttggttgtaattctaaagcttgcttttatcctgtcaccatcaaacacgccgcatgttatgtttgtatttcctacgtccagtgctaaaatcatctgttattcctcctcgagtccttctcccaaaaatactatgcgataatacgtctctatcgactcgagcagctctcttcgctcgttgcggtactgctttatctttagcacgcttcctatctcgtcatagaaaaagtcgttttccttgcaggatgttctgaaatcgaggtttccgtcctcatcaaacaccagctccagtatgcctcccacatcctctgtatacaggacgcacatgattttgagctcgtcccttattgtctgtggaagtccgttaaaattctcgttcagataatattttttctgatatgcgtttgacacgcaaagtactacctctttagacatatccgtatattcctctcactgatacttctccgcttgaaaccagcttgcgcgattcccatgtgtccacgatcagctcgcccttaggcgtgatgcccatcgcttttccgtcaaacggctccttcggatccagtacccttactgatttgttcctgttgaccaacagctcatcatactccctgacgagggctgaaaggtcctgcgtctttaaaaatgtgtcataatactgctcaaagtatgacatggtctctgcgattatctgcgcacggtgaaatcttttgccacctgcttctatcatgagtgagctcgccatctgactgatttcctccggaaagctctcattgtgcacgttgataccgatacctacaacaatatggttgatgtagtcaaactgcgcattcatctctgtgagtatgccgcacacctttttgccgtttaccacaatgtcgtttggccactttatcagggcttcctcgccggtaacgcttgttattgcctttgcgaccgcaagcgctgccacaagtgtgagcatggatgcattgtttggattgatatcaggctttatcataagtgtcatgaaaatacctgtgccggacggcgatacccagctgcggccgcggcgcccctttcctgactcctgcttgtccgctacgactaaggtgccgctcggatagcctttttcggcaagctcctgagccttgatgttggtggagtctattgtatcaaaatacagcacttcctttgccacccagtctgtgtgcatgaggctttttatctccgcctctgtcatcagatccggcgctgccatgagcctgtagcccttattctgttgtgcctctatctcatacccggcttcctttagctggtttatggccttccacacggctgtgcgcgatactccgaaccggttgcatagctcctgccctgaaatatagccgtcagcgctgcgtagaagtctaagtatttcttccttcatactttattccttagctttccgtcaatcttttgttgcggtcattgcttaccgtactagtcagcaagtgttgcacgcatgatagccttgattgagtgcatacggttctctgcctcatcaaataccactgagcgctctgactcaaatacctcgtctgtcacctcaagctcgctcagtccaaacttctcatagacctgcttgccgattgtagtctttaaatcatggaatgcaggcagacagtgcataaagattgcgctatcctttgcattttcaaatgcttttgcatttacctgatatggctttaagtcgttaattcgctctgcccataccccttccggttctcccattgatacccacacatctgtgtaaatgacatctgcgtcctttgtgccctctgccacatcctctgtgagtgtgattgatgcgccggttgtttctgcaacgtccttacagtattttacaagctcatcatttgggaaatatttcttgtttgtgcatgccacgaagtccatgccaagctttgcacatgtgaccatgagtgaattgcccatgttgtatcttgcatctcccatgtatacaaatttcacgcccttaagtctgccgaggtgctcacggattgtaagcatatctgctatcatctgtgtcgggtggaactcatttgtcaggccgttccataccggtacgcctgcgtatttagccagctcctccacgatttcctgtccgtatccacggtactcgattccgtcaaacattctgccgagcacgcgcgctgtatcggcgatactctcctttttgcctatctgtgaaccgctcgggtcaaggtatgtgacatgcattccaaggtcatgtgccgctacctcaaaagagcagcgagttctggtactggtcttttcaaaaatcagcgctatattcttgcctgtgaggtcatcatgtctgatgccttttttcttcttttccttcagctcctgtgagaggtcaatcagataagtaatctcttccggagtgtaatccataagttttaaaaagtttcgtccctttaactgcattgctcttgcctcctgggttttatttgcatcgtttatagatgcaggttgctgtaatttatatctgtaggttgctataatgatgtcattttactctattttgtggtatgttgcaagaggtttgaagcattgacgctctgactgtaaaaccacgccgtacaaataattaaagaggctgcaaaccaacaagctttgttgatttgcagcctctttgttatttctttatatcggctgtatattatctgaacttcatatttccgattgatattcctgagccgtggtcattgaaggatgtacatcctcccgtgttgtccactccggacattgcctcctgtgctgcactgtagcatgaagaagaaatgcgtccgctaagctttcttgcgagctttcctgatgatgccggtccaaactggcctttctggtaaataacacctgagatgctgtttggatatgagccgctctttactctgttgatgactgccgctcctactgcgagctgacattcatagctctctccgcctgcctcacactcgatgattgctgcaagcagtgtcaggtcatctgctcctgcacttactgcctcgccctgtgtggtctctgttttctttgattcctttgctgcttttgcagcttcttttgctgccttttcttctgcagcctttctctcagcctctttctgtgcagctatctgagcctgttcctcttcaattgtgatacccactcttgtgttgagggaacgtgtcgcataatctgctgcgatatatcctgtctgtgaatcgctgactactgcaatccagccgtccggtgcctgcgctgcgcggtccacctgataggtcttgccctggtcagctacctctaaggccttgctgtttgtatctgctgtctctctcacacgaagtccgtctgtatttactgtagcaatttctccgcatgtgtcgtaagcatagtttagtgcgtcagttccggtcacacagtaagatacattgacatatccgtctacatttcctgacttgatgtgagcccatgtgccatcgttttctacgatgtctgccacacttcctttatatagttttccaacaatatctgactgttcatcggcctgtgctcttacgttgagtgattcttcaacttttggcataagctttgtctgccattcctgctgctcctgtgtgagctgtggctgtgcctcctgctgtgcatcctgtgctgctgccaccatctcaacattttctttttctactgtaacagcattctctgctgtgagacccttctcataatcaaaaagagtcgctgccacgccagcataactattataaccagtatgctctaaaccagtgtttgctagcaccttatcctctgctttgacctcagagcgtccgctgttagtaaccgcggtaaccgtcagcatggcgcacagtccacagaccgtaatgctatcgattacttttttgtttagcttcatataatcctccatatggtgtagtatatgttgtttttgttacgtttattacacctatgttgcatttgttacaactttgttacagtcggtataatatcacagtaatatcattttgtcaaatttcatggaaaaatctcctgcagcaccgatgaaatcaccccattctgatgtgccttatgctctatctccagcttgtcgctttcgcttctagacagctcgtctatgtagtcgctcacctgtttttctattttataaatctcgttgctcaaaagtcttatcctgtgtgagagtgcgaacaaggtcacaatgactgtcagcatgaaaagtgcaagcattatcgcaagtatgcctcctgccacgatgtccatattgtccattgataattccatattaatgtgtcctccctactattctttttccgatacatcattcaaaatttaacttaacctataacgcaggatgatgtactattgattattataaccaattcacttgaacttaacagttcctatcggtcgcaagtttcgacatttgtttggtattgcagggcaaactttcaccggtaacttggtattgacttttattgtgttgagtataatataaatatgagacaaacaggaatgtaagaaaggatacatatatatgaagaaaatagttatgacaggcggcggtactgcaggtcatgtcactccaaatatagctcttatgccggcacttaaggaggccggatacgatatcgaatacattggttcagtaaacggaatggagaagggactgatcgaagcccagaagattccttaccacggcatttcatcaggaaaactgcgccgatactttgattggaagaactttacagacccgttccgcgtgttaaagggctacggtcaggctgtaagcctcatgaaaaaactcaagcctgatgtagtattttctaagggtggcttcgtttccgtacctgtcgtgcttgccgcaaagcactgccatgtacctgccatcatccacgagtcggatatcacaccgggacttgccaataaaatcgccataaagggtgccaaaaaggtctgctgcaatttccctgagaccatgaaatatctgcctgcagacaaggctgtgctcaccggatcacctatcagacgcgagctttttagcggcgttgccgaaaatgccataaaactttgtaattttcctgaccacaataagcctgtcatcctcatcatcggaggaagcctcggctctaaaaaggttaatgaagctgtccgtgagattcttcctgaactactaaaggatttctatgtgattcacctctgcggaaagggcaatctggacaacaagcttgccggaatcacaggctatgcacagtttgagtacgccaatgctgagctcaccgacatgtttgctctggctgacatggctatttcaagagccggagccaactccatctgcgagctgcttgctctgcacaagccaaacatcctgattcctctttctgctgctgccagccgcggagaccaggtattaaatgcaaaatccttcaaaaagcagggcttttcatatgtcatcgaggaggaggagctcacaaaggattctctgcttagcgcagtaaaagaggtgtacggcaacagggataaatataaggatgccatggcaaaaagcggtcagatggattccatcgccactatcattgatttgattaactctcaggtgaagaaatcgtcataggatcagagtctgtttaaagcgtcattgcatatcataaaaaagaaaagcccggatatgaactacatttgcatatccgggcttttggttttttataatgtgtaactattagcagctattacatgctcatctcgtcacagattttcttcatctcgtcatcagtgaactccttatggttccactctatgacattcttattgtcatctgactcatatcttggaatcaggtgcatatggaaatggaatactgtctggcctgccacctcgccattgttctgtaccaggttgtagccttcacagccaagcacatctttctcgtgtgtcataatcttctttgcaagctttgctgccttggcaagtgtctcatcctcaatctcaaaaatatttgcataatgctgctttggaaggataagtgcatgtccctttgtagcaggacttgcatcgagtattaccttgaaatcatcatcctcgtagattgaattggccgggatatccccatttgccagtttacagaaaatacagttgtcatctttcatctttgtcacctcatatatataattattttgtaactgttaagaatcaaaaatcccattaaaacggaaatatctgatcaagcatgcgcagtgtcttgaaattgccttttgctgtcatttctccggtcataaatgctctctggaaggtcatgtgaccatctattatagactccatgatactcttcgaaaatttggcgtatacatccactatatcctcttcgccatagtgtatatccagcttatcctcatccacctttatatataatggatttttaatgccctctatattaaatgaatagcaggctttgaattcacgaagtggaataaaatgtgcttcaagctcctttatatatggcatgtcatctgtagatgcctgctgcccgagcatgtccttgaacatggttgcaagctcctcgatatcctccttctgctgctttacatatgtatcatcagacacatacttcgacagctgctcgctctcctgtggggtgagattgagctgctgtgtcctgagtacactttgcttcactgcctgattgcttgtaggcaggctcttaatcttctgggatatcgtgcgatacagattctccgcgcgtttttctattatgagattatactccttattgagctgaaacgtagtaatatcctctacatatccgcataaccctgagcacggcagaccgccaagtatctcccatgcattgcatagtgtggtctctgcctcgcgctctccatatgtggtagacataacaataggctgcatatatgtattgcttatcttttccttatcaccgtagagccagcatgcatcaaggaactgctgcatatatccacctataccaagccactcaaccgtcgttgcgagaatgattccatctacatctctgaaggtctgtggcaatgtagctatttcattcttgtgctcatagatattgtatctctccacctttacgcggagctcctttagcacattttctatcctgcttatcacatacagtgtcgggtcgtccagtaaacctcttccaccataataaatatttatcttcatgtagcttctcctaccattaatttttagttgatattatatttattatatctctttttgcgatataaaacaattgaaataacaaatccgcctacgagcccgcctccatgagcccaattgtccactccctgcgttgaaactccatagtatatcatcagtataaccataaatacagcctgctgtctgctgatgccctcataaaaacctctgtttgctataactatccacacaagtgctcccaccagaccaaatatcgccccggaggcgcctgccgataccgcaaagtcattattataaagcataacgatgtacgataatacacttccacacatgcctgacacaagaaatgtgatcagaagcttcacatgccccatggctttctcgactatctgaccgacagcacctaaaaccaccatattgttaagtatatgcatcaatccaaaatgcataaacatcgaagtgaacagcctccagtactggccatcctttatatactcagggtacatggctccgtgggcagccatatactgtgcatcaagtgtgctgcctgatatactcatcagcacaaaaactattatatttaccaccattatgccaattgtcatatatggtttatcatcaaagctttttatattctgcaaatttgtggggtctccttaattttcctgttaaatacttttttcttattataaattttaaggagcttatttgcaacaattatacaaaccggtacttaacatcggcaaatctgatgatatcatttgacttgagctgcttcttctgcttgtacgcaagcacctcattattcacaaaggttccatttgtggagtttaaatcctccagataaaattcctggttttccctatttataactgcatgaaaatgacttattgtatccttgcctattaccgcatcggcctcatcaccctgaccaatacgcgtacaatctttgtctattattatattgctgcggttttccatgccctcatacaatagcatgccctgtgggtgctccctgtaatcgctcagacatactgtggggtgtatctgacgcggtacaggctccggtgcagtctctgagcttgggtgtataagcatggtgtcatctaccttttcacgattttcttttcgtttttcttttttaaaccattttctgtttatgtccggttttttaggcttttctatcactgacgcctgcttctttcgctccggcagcctgatatccagctgctccagcagatacacccgaagcttatcgtacagtgtaggctttatctgctccttaggctcctctactctgacctgtggctgtgaaatcggcgcaaccacctcctccaccggcttttctgccacctttttctgtcgctcctcgattatggcatttctaatatcagcgatactgtaattgccatttatggttttctcgtatatgccatatgctatatgtatcgcttcagcatcactgtgatcaagcttagttagcatatactccatcaaatgcgaaaatgtattgcaaatggttttcatctgcgccgggtatgctgtaaaatatatttcctcatcctgatttaccccttttatgtgtattagctgaggatcaagcaccagagattctgcgctaacaagatgattctccaaaagctcaagcttgttacagatactcaccacaagcttttcaagaaactcaagctttatatcattatactggcagcgcatttccaaagactggactccggatatatcataccagtactgcccttcattattcacataacacttctccatcttcagaaagcccggaatattgtttttcaacaatatcttttcatctaacggcttcacctcgtcacaacgcagcttcataaagctgcctgtcatctttctttcatatactatttcattagaattcatttacaacctctttcaaaacctgataattatagaaatcatccaccagccacatatcagtagcatactcataagagctgtctgctttcatttcgttatacagcacaagtcccatcttcatcgctatcgcaagcataacaataaatataggtataataatcgttccttccactgtgtaactgccttttagtccataagataaatctacatttaatttattttcagtcacataaacacctccgtcagtccatatccaagcagtaggaatggtgtaaatgcaatctgcttctttcttccagccctgcctgatgcaattaaaataactgagattgttcccgctattgtcagtcccatcaccatagtgctgcacactatgtcagcagtcacaaacaatcccataatcgtcacaacagctgcatctccatagcctatctgctctcctgtaagaaatgcagctgccataagcactataccgggaatcagggcaacagtcactgatataattgactgctttgcataaaaagagcttgcaatacccaccatacccattactaccaatacaactaccggtatctttttggttgaaaagtcaattatactgattattccaagtaaaatgataagctgtatcatgttccttctcctttacatttactgcacagatttttgccatctacctcagacttatgcaccttgtgtactgtccgcttaagcttactgcatccaagctttccgtgatagttcatgccataatctgttataaataccgttgaaccttctgtttttttatccgcggcacagtaacatgcgtggtatttcctaccatctttgtttctgcttgcccccacctgtgaccatttgatgctctttatgctcagatccaggtaattgcattgctcggacaggtgataaacactgccatagtcagtgtaaaatacatatgggtccgttttttcgccgggattttttcctgtccatttcctgctgttgctataatcctctatccatattccgtccacagtaaaaaagctcaccggaagctttaccttgtactttgccttaagcgagacatcatcaccatccatacttgagccaagcagtgacactccatactttccaccactcacgtatgtatcaatgtgcttcgagtcagatatttggctcctgaatagtacctctgcagtggccactgatacaactgacgaatcgtttgcactgctcgctaatgcactcatcctggatgaataatacagagcagccttcacctgcgactccacctgaaccaccctgaagaaaaaaagtataaatacaaaaaagcctgctacaagcggaaatattaccgcagcctcaagtgtatatgacgctttcaggcaggtgcatgagggcatcttttgagaactatcatcgcctgggagtttggcctttctataaagtttttttatgtggaactttactttattaacaaaagacaccttcatacacctgcctttcttatttcgtcatcgtccataataggaatactttgccttatttttaatgatatactcgttatctgccccatctaacagattcacaaagcataaaaatatgccatgatatttgtagcttacatctgtactaagctcacagattgcattgtccatcctaaagctttcatgcgcaccggtcatacgcactgtagcctcctgcacatccatcgagcgatacgctatatttttcatgctctttgtaaaaagcagcatacccagatatgatttgtagcctattccttcatttgagctttttgccttcacctgccctgtgagcatgcttgtcatgccatacagactcgatgtccatgacgtatcactttttatcagtggaatcttatccccatccaaaagtgcccttaaatccagcacactttcacagaatgcccaggccgccagaattcccttttccaccccttcaattacctccggtgtcagagtaattccaccgataattgcagcaagagccatcgcctgtgcctgctttgatgcgcttcctgccaggtatgccatattggcagccgcacgcagagccagtatttctgctataacgatcttcagattatccttatcactcgctctgcctcctatgatgtactccacctcatagttaagggcatgattgggatttgtatcagtgtaacaactcatatatgtcagaatatactgctgcataagtactttcgcataccagtcatcaccactttcggaccagccccctgttcctttatgcagacttcgcccggacactctggctgatgtatcaatactgtttcctgacaccgtgctctcatcaaccacctgcgataatatgcctgatgcctttactttctgcaccttgaccagcggattttctattgcattaccgccttctgtgctttctgccttactttctgacgtctgctttgctttcgaaaccgatgaaggaacactgtaagctcttggcggtgacgacctcgctatgcttttgcctccgccttcatgagctgcattatcctttaaggcttttaacgcactatctattttactgtcatcatactcacccgcagacttgttttcattcaatgagctatactgactgtaaagatttttgactgtttcataaccaatatttttcttcatatatgagacaaccgcatttgtatacacatcaccaccatcatccgtcatgagcacatatttcatggattcgagctcatccattgacaaccttagcatactggtgccgtttacaatagtacccccggcaaaagctcctgaatcgcttatcttaaaattgtcagtcgtaagctgcttcatatacgacttgacattttcgatatccacattgcccattgcgtcacttccggcgtcatacgctaacagatggtattcatcccacaatggtctgcaatactgtgcaaaaactgactctgctacagcctctgaattcatgcatgctatattggtaagtgtcagattcctgccggcttccagtacagtaaacagaaactgtgacaccagcatgagaagcattgtggcaaatatcgttatactgcctctcacactttaccagcctctcttgagattgtctgaaagatattgtttacaagtgtcgtaagctgcttcttaaaaatcagcaccagaccgattaacacaacaattatcagtatcatttccactactcctgcgccatcctcatctaacaaaaaattcttaaatcctaacataatttttcctttctatatcttaaaatcaataattgcgggtgctattactattgctatgactatagccatcataagcatcatcggcataagcattttggtgccggcctcttcacccagctttaaggctaaaagcctcctctcatcaaatgcatcctccgattccttctcgagaatttcacatacacccttacttcctttgtgaatactctgtaaaataatgcgtacaagcttctgatagcatggcagctttactctttccgcaaaatctgcgtatgcttttctgcctgtcacgccatctgagatttctctctccgtcacaagcatttcctcgtaagcgggcataatattcttatcattatttttccgctcatcaagataacgggcggtaatcctattccatgcctgctccacagtcattcctgaacccatcaaaacagccattttgctgactatctccggatattcgagctgcagttgtatatttctctccttctgcgccgtcttctttttttcctttttctcaagcaccagaagaactataacaacaacttcaagcatggctattttagctgccgtattgcttttttcctgcgaccagctgagctttactccatctacttcatccggcagtgtaagctttttagtgcctgtctttgacatctcactgtcaatatgtctgttgatatcctttatgaggcgctcgcctgcgtccaattcatccggaaataccacaaatgagaaatcatacagctgtctgtgttcgccacaggaaagctcaacacttgcactaatcagctttccctgttcatcatcagcctcctcaaatgcatcctggttcacatctccattaatatcaaccacatcatagtcactcagtgtccactctgcctccacagctcccgatgcatatgcatccttcataatcacatgccctctgacctgttccacactctgattctcttcacaaaagctgtcgtctatctctttttttgcctgtgtaaacagctcattcgcctgtttatccgaaggctgctcctccataaccttcagctgatagctgtaatcctcatcgagtccatccgcatttagcaccagatcatatactgcatctccgtcacctgtatcattgcgtataagtgtattatcagttatagcatttgacgacatgtccatgataaaagcaaaaactaaaactataacaaataatgctgctattctaagcctctttcctcccgtcatatgcctattcctacctgtaaaaatttctttgccagtttaattgcccctgcataggctaaaagacaggtactcataaagattaccccgatcaggtttccatatagtgcagacatataatctcttgaagacagctttaaaaatgccaaaagaaatatcggaatatagttcatagtcttttgctcaagtcttttggcagaaaccgcaacctctatctgtcggttggtatcatactttgtccacatcctgtaagtggtagactctatgatatccacaaatctgccgccgcttctctttgcaaatgagaaaatatcagaaaaattgactatatcctccagaccgcttctatgagcaaattctgacagcaccgcctcaaatgtctgattcatctttatctgcctgttcatctcccgtatctcagacagcataagcgaatcattcccatacatgagctccatctctttttcagcctcctgccatgcattctccacagagtatccggccagcatattcgagctcaataccttaagtacattcataaactcttcatttagtttttccttttgtcttctgacaccctcctgcctgcacagctttgcacaatacgcaaacaccgccggaaaagcaataacaacaataggactgtcataaaacaaatatgcgataatcactgtggcagccatactttttatgaaaacaatcccccaatcctttgtggacatggaatatctgctgtaatccatataatcaaacccttcataactgttcagtaacatatattcctatactgacagctacagcctttcttactttaaatgccacataacagcctatacactaagccctgctgccataagcttgtcggtgtgacaaagtgtccctgctttctttaaaaagccctgtatcctcccactatccaaaacagcggtttcctcaaaacgatacagcgtatgcagcacaatttcaccatccataaatccatccacctctgatatctcaaggactctcctgcttttatccctcagcctgccaagctggacaataatatctattccggatgctatctgctgccgtatcgcattgagtgggaaatcctgaccttgaagcaccatagtctcaattcttgaaatgatatcatgtggtgaattggcatggccggtggacaacgagccgtcatgtcctgtattcatagcctgaagcatatcaagtgcctctgcacctctgcactcgcccactattatcctgtccggtctcatacgaagagccgtcctgataagatctcttattgtaattggagtaaccccatcggtatttgcatttctggtctcaagccttactatatttttagctcccagaagctgcagctccgctgagtcttcaattgtaataattctctcatcatcaggaatatattgtgacagagcattcaggaaggtcgttttcccggagcctgtaccacctgaaataaatatattgtatttggcctgcatcagtatctgtagaagccttgccacctccggcgagagagcttctatctcaacaagcctctccatgctcataggatgctccggaaactttctgattgatacagccgagccgcctatagatatggggtttagcactatatttaccctggagccgtcactaagcctggtatcaactatcggtgatgcctgatttacaaccctgttatggcgtcccacaatctgctgtatcacatcctccagcttctcttccgatgaaaaatgacccttgaacctttggattcttccggctttttcatagaatatatcattgggaccgtttaccataatttcagtcacatccctgtcatccaccagctcctgcagcacatcaagcttacgcagagagttgaatatggtgcgctcaagctcagctctatcctttatagtcattggtctgtcgcgtgcctctcttgaaaccacgcttccgattaaatcacatatttcctcatcactcagctctctggacaaatccatttcagaaagtataatatctcttattctctgtccaaaatcatccagcacacgaaataccccgagtcatgtttcttatgacatctccaaactcattccacttccacagctctacaagcttatcacatgtagataccggtgtcgtgatgaccggaggctcaatcagcttaatcctctcaactacattgcttaagcctctttcaatcagttcctctgtaaactcgtactctctccactggctgattccgccttttttctgtaccaggtagatatcactgcatctgtcaagaatatcaaaaaagcccttaaatcttgttcccatattgagaactatgcagtcatagtgcatttccttgccaagcatctgaagcagattgttacatattaccgtatttatttcacacagacactctgtattttcaatcggatatacataatccagcttatgctttcttccgatacagctgtttatcctgttggtcgagtatcgtccggattcggccatcaccaatagctcgtccagattatgctccacactctgctcaagcatccgcgataatccactattctcctgaaaatccataagcagtaccttttcattctcactcaaaatagaggacaaagtcatcgcaaaaggcatctggtactgattatcagcaagtgaatacacacttataagcctcgtctgacctatcaaagagccctcactcgtcaggtctctcacctcaccgcccacatgctttaaaatctcttccactatgcggtttacttcctgatatttttccacaaagtatataccctcctcactctcaataggtgtttcctcaacaatctgtatcagtgggatatacttgttattccactggtcaagctcacttgaaagcatgatatctatctcgccctctaagtgttccagctgctctttcatggtatacatatgtatctccagctgatccttataatgattcatgaaatagcatgtcagtctatcgccatattctgaatcctcaatataaattcctagtctgatttttttcatctatggtactttaaccctccttccatcacctcatgccgtaaaaccagatatctgccatggctgttcccaaaagcacgtataccgcgaaactaacagctttcccctgtccgcggtaccgcataaatctgccacacagtataccgtttaagtataaaaatccatccctcatacgcacaaagagctcctttttaagcaccatacttatgagaccatatcccgctgccgccacaaaagcggctgccatgcacaaggcggtaaatcttaaatttgtaaatgcacatactactgaaaataacttgatatccccggctcctaaaatgcctgaaagatataagaaatataaaatgacaaccggaaaaactatatctggaagaaaccagatgatgctcgctaccttgccccccactaagcgaaatagaaacgcacaaccaagtcccgtcagaatcagccggttactgattctataatttttgaaatccccaattgctgctactgtaagcagtatatacagcatgaggtgtgatattaatttcacaatcactgtattttcatcacctctcctttcgtgagacgaattataacaacgcactctcgattttgtctatagcttttttaaaaataaatactttttgttagttatccacaaaatgcagctaaacccaacacattaatccacagtcaaaaccttgattttactggtttttcacatgtcaaaagcactttttacaaaatctgtgaatagaagaaactcttttgcttatacttgtattaagacttattttgttggaggaattcatgaaattatttaaagaaacgcctgtaaatgacggttacaagaccttacaggatgacatcaagaaaacaacagatgaacttcaaattgtatacactaacctagaaaatgtggttgagcccgatttaattgactactacatctatcaggccaaggctgtttccatgcggtataaatttctattaaactgtgccaagcggcttaatgaggtttaatgaggcttaatgaactaaaaaagaggcctcctacgcaaggaagcccctgttatcatcgtttataaagctctctgtgagcctgccccttccataggtcatgcccgcatagaccttctgcgcattgtccataagcggagccgatttgtcatcggcagctgctgtttcaaagctgtttctgagctttttcataatgacatcggcctcatccaccaccgacacatcaagtgagtaaagcactgtggaaaaaagcctcttgcagtatgagtacagtggataaagctgtcctgcgagaggatacttaaagtcaagtgcccccatcagctcatcaagtgccgcctgtacatccgacactccctttctcaaggcttccctgtcctctgacacgagggcattttttacatcatctgaaaaaccaaaatatatatcatacataacaagcacgagtccgccattgttgcacgcacaaagtcttctggtgagctcctgcttcaattcatttttcattgcttattacctcgacaataatgaaagtacctgctgtggcaggtcatttgcctgagacagcactgagattccggcctggtcgagaatattctgtgctgcgtattccgtcatctcggttgccatgtcggtatccatgatattggaatatgcaccggtcatgttctcagaagtctcagaaagactgctctcagcagattccagacggttttggaaggctcctatccttgaccgcacaccagagacatactctatcgcctcatcaagtgtggacattgccttgtctgcaccaccctttacagtcacatctaccgtatccagataaagtgtctgcgatgatacctccggtatcctgattttcatctcctggccctcgtttgcaccaatctgtacagccatatttccgatatctgaaatatctatctgcagattgctgcttcccgctgtcatatccatatcactgctcagtagaaaatccattgaaaatccactgtttccaaccacatatacacggttgccgtcggctcttattgtcttgtccgacagattttctccgcctgtaaccacggcatccttaccgttacttttgagctgcatatttccacttccatcgtcagcattctcatagcctgcacctgccagagccttaagcgatgaagaaagagatatatttactgtgctgtcgctgccatactcatttgataaaaaactgatgctatcaccattcacctgcatagtagtaccggctgtggtcgctgccttctgcaacgcctgaatatactcatcctgagtcatatctgccttcacagccacacttacaccgtttatggaaatcgttccctctgcgtctggctttgtggcagacgcgagacttcctgttgcctgtgttgcgagcgaatttactgtaagctcatatttatctgatgccacattgtctgagaaattgattctggtaatatagctgttcacctgagtcatattgccatttgcatccttctgccttacatagacgcgtgtatcactcgaaccatcgagcagtgactttgtattgtactccgtatcgcccgatatacggtccacctccttggtgagctcatctatctctgactgcaaagcctttttatcattctcagaatatgtatctgaagcgccctgtaccgcaagctccctgattctctggagcatgctgcttacctcaccaagtgctccgtctgctattttcataacattctgcgcatctgacgaatttgattttgcctggtcaagcgcttctatctgcgccttcatcttgttggagatagccattcctgccggattgtcctctgctgaatttatcttgtagccgcttgaaagccttttcatagactttgataatctgttttctgtaccgaggagctgcttatttgccctgacagcactcatattcctgtttattttcatgtgttttcctttcctgataatttctcaggcatccttgctgtagtattaacattccgttgtctaataagtatatcgaactactcaaaaaaaatctttatagtataatttgcaattaaatgcaaatcgtattataataggcacattaaaagactaataggaggaaacaataatggctagagttactaaggacactatgattggtgatcttcttcagattgaccagaacgtggcaccattacttttaaatatcggcatgcactgtctcggatgcccatcatcacagatggagacaatcgaagaggctgctatggttcacggacttgacccggatgatcttgtcgttgaaatcaacacattcatcgatcacgacctcggttaatttacgaaaagacggcttgcttatgcaggccgtcttttatttgcaatcaatattctgttaaagtgctgccagcgtctggatggcggcttcttcaataatcacattaccatgctccttgaaaaatgcttcattggcaggcacatagttcttctgatatgcgtactctgaaataatattgcacactttattgaattccttcggagtatgctcactcttgtgtgccacaagatagtacttattgcttgaagcgtcgcggtataagtcatttctgccgctgtaaaagccgtcaagcacatgcgaaatcctgcgcacatcatcaaatttatcaaaaacaaacagcttgactacgtcagcctcagcctgttcttctgtaatatcatcagtgctctgctcactgtcagctgtcttctcattttccttcttgatacgctcaaacagctccaaaatatcagcagctccctttatcaccggaggctgtcctgcatttcctaagtccgtaaagtcgtcatctgcctctgaaaactttgaaaatctggtgtcaagctcatccggatattcaacctttgtgattataagcactatagactctgatggcagtggaattgcctccaccatgagtggaatatcatttgtttcaaagccaaactcgtaattggcctgctctaccatatctttaaaaaggcttttcgccttcgctgatccatatgccagttcgcttatttttatatgtctgtcctcaagatcctctctggtaagagtacagcggatctgattatcatttaccttctcaattttcatatttttcacatccttttccgaaaatatccgtgtaaatcgtaaaactattataataaacaccggtcatattgtaaagcgcgaggcctattaaaaaaaaataaaaaaattgttgcaattattttacaggtatgttataagttatccatgagatgtgcgctcgacccaaaaggagcgtatgaaaaatacaaatcattctttgtttgacaaatatgagatgattaaagatctcggaaccggcagctccggtagcgttacgcttgtcagacacatatctatggatcaggagagagctctaaagaaagttcctaaagcttctgctttcgccgaatccgcattatcagaagcaagactactcaagtctcttgagcatccgtctataccacgtatatttgacttcgaagaggacgatgctttttactatatcgtcgaggaatatatcgacggcgagacattagattcatttttgcttcatcagcagttaatttccccaggtttattttttaatatttgtgaacaattatgcaatgtttttatctatctgcatacacagatatctactcccattatttacagggaccttaaaccggagcatattatagtatgccacaataagcttaagcttatcgattttggcgtatcggcatatgttatccaggctggaaataacttcaatcactatgggaatatagaattctctgcccccgaatgctttaccgaggatacaattacaccggcggcagacatttacagcttaggtcagcttctgcagtatatactgacctttaccccagacagcttttcccataagtttcagcatattatccaaaaagcaacaacatctgatgcatcactgcgttacgtgactgtcgcagagctatatcaggaaatacaggaaattcaaaaattaaccggtcagccacatctcatacataaaatagcagttttaggcagtcacagaggctgcggctccacccacgtggccgtttcactcacctgcgaactcaatatccttggatatcatggtatctacatagactcagcaaaaagcgtactttgccatggtaatcacgacggactgcagatttttaagcagaaaaacggatattattattacaaaagctttcagggcatacccgactacagtgacggtatacagtttaatattccaaaagatgctatacagatatacgaccttggcactgatgtgtgcaacgagaaaatatatgacatggatctcgtattatatgtatgtaacggcggcttttggcatctgaatgatatctacaggaatcattctattctcaaaaaaatgacagcttccctgagtgttatatgtaatatgtgcagcagacaggatgcctccgcgattgcggcactacttaattgcagtgtttatcactttccttatgacagcgatatgtttaagagctcagttcaaaaggaaacgctgattcaaaagctgttagaactaaagggaggagcatcactatcagacactttaaaaggatatttaagaaagtccattctgcaccacagttagttggggtctgtggcagcgttcacaatgtaggcacaacacatataagccttgctctttgtaattatatgagcaataaatgcatgtatagaaccgcctatgttgagctgaatggtacacacgaaattctttcactgtcaaagacagcagacgaaaaggtttttacttataagaatgtagatttctttcctcacgcagtcatgtccacactaactgagattttaaacatgagatacgagcgtgtgattattgatttcggcatacttaatccaaacaccttaaaggaatttatgaggtgtgacgtaagaatcgctgtgtgtacaataagtaaatggaaccggggcgctttgaacagaattatcgagctattcaattcaaacaaaataactgattcagaaagcgtaaaaatattgtttaatctcgtggaaaagaaaaagacaattaaccataaacattttaagtatccggtggtaggctttccttacttagaggacccgttcctcatcaataccagcctgtttggcactctggataagatatcagaaaggaattaatatcacgatgcaaaatgacatctttaaccagctgtttatcaattttatgtccgaagccttcggagggcttatacttttaatgccacagagcgcttcatgacatagggccatttgttacttatcagtttttactcataatcattatatatagacggaggtatttttatagaagaataaactatatttatatattggaatttttacagatattttatcaaattaaacgaaactaaaaatcagcaattaaattgggtgtggaaagctccggaaatatcaatttctataaactgtcaataattaatgattaatatcattttttctcaattatacaagaaatcgatgtcagcatatttttggttctttaccccgtttaaatgcaaaaagacaaccaaaagacatattttaaaaagaaagctatgtgcgcgggggaagcttttgctccttccgcgccaaaatgcataaacaaatttcttaatttattacaaatttatttcatattatttgaatatgctttttcacaatggtataattagcttaagcaatttcgacaccaaataataggaaaggatttttacacatgaaaaagaaattattgcctgcacttatagtaaccggacttattatcctcgttgtaataataatgggtataactgctcttatcaataaatacacccctacgaaaaagacagaggatcttaaagagtatttcaatatctcttctgatgatgaggctgctctcattgtagataatgagctatccgattacaaggctaaaataatagataaaaaaatatacgttgattacaaatttgttcacgactcattaaattccagattttactgggatgcaaatgagaatgtgcttctttacacaaccgcatctgatatcatctcagctgcggctgacagcaatagctacagtgtcaccaagcagacaaatgactttggctatccgattgtgaaagccacctctgactctgcgcttatcgctttagactatgtaaaacagtactccaatatcacctttaagtcatatgatgacccggaacgcatcgtcatcacaagcaaatgggatgaaatagacagtgccactgtcagcaagtctacccaggtccgcgtgaagggcggcataaagagccctattctaaaagaggtgaaaaaggatgacaagattactattcttgattccggtgacaaatgggataaggttgccactgaggatggtgttattggatatataaagcgcaaggctctgtccgagagcaaaaaaactaagcttacgaatcctgactatgaggaagagacctttacgcatatcaagaaggataaggatatctgtcttgcctggaatcaggtaacaagccagtcagcaaacagtaaagtgccacaggtaatttcatcaaccaagggcataaatgtaatgtcaccaacttggttttatttaaatgacaacaacggtaatctggcagatatagcaagcaaggattatgtcagctactgccattcccagggcatcgaggtatggggactgttcagcaactttgaaaatactgatgtagatgcagcatatgttctcacacatacatccacgagaactaccctgatcaatcagattatgtcggctgcatttaactatgagcttgatggtgtaaatattgactttgaaaatatcacagaagcagcatatggagactcttacatcgagtttatcagagagctcgccataaagtgtcacaataacggtatatcactttcagttgatgtcacagtacctgccagcttcaacaagttcttcaatcgctctgatatggcaaactttgccgattatattgtgattatgggatacgatgaacactataagggctctgatgccggctcagtttcttctattccgtgggtaactgagggtgttgaatccactctgaaggaggttcccgctgaccagattattctcggcatgcctttttataccagaatatgggagctcactccaaaggaggacgatgatgccgtaaccgataccgaggatcagtcaaagtacactgttgcctcacaggtatatagtatggacgcagctgcagcacagcttgccacaaacaatgccactgctgctcttgatgaggaatccggtcagaactacgctgagtggtctgtatccaacaagctgtacaaggtatggctcgaggacagtacatctttagagaaaaggctcaagctcgtcgacgacaataagctcgccggtgcagcattctggaagcttggctttgagaattcatctgtctgggatactgttatcaaatatctgaactgattgcttaaggcttactgaaagaggccgtacctttaacagctacagtctaactcagtaccttttataggttataaatgatatcagccaatcatataatatacaaacacacccgatgcttctatgtgcatcgggttttttataggtatcttatatgaaaaaatatatgtacattatcaagaaaaacaaatactgtcttattttagctctctttattctgtccttctacctcggaagaggtgtctgcgctcttgcaaaaaacaccggcaaaaacactaattcaactgttattgtaatagacccgggccatggtggaagtgatcccggtaagatttccacctccggcgtcatggaaaaggatgtcaacctgagtattgcaatggctcttaaacagctgtttgaaaacagaggctttactgttgtcatgaccagaaccaccgactgcgacctcgccccggataattccaagcatccaaagacagatgatctcacaaagagaactgccctgatgtctaaaagcaatgtggcagtcagcatcagtatccatcaaaacagctttgaggacagttcaagctgcggtccacaggtattctattatgaagcctctgatgcaggaaaagagctcgcatcctctattcttggagctttaaacacttctctttgtgtcgcaaagccacgaagcattaagcccaataaagaatactttatacttaaaaaatccacatccccgaccgtaatcgtagaatgtggattcttgagtaatcctgctgagacacttcttcttactgacaaaaactatcaggatgacctggcgcatgctatatatatcggtgttacagactatcttgcgcaatcaccctctggacatttacaataaactgctctgcgatatgatatagtctggttgtctggacactttcactaccatcaagctgctttttagtctcattatctgacatcttagactcttttgcagatatatcatgctccagtgccacatctatgcgcacacgctgttcaccatcacttattcctgcctcaaacatagtgatattgtcttcaaacagctttttagtctgctcatcgtctgtgactatcatagcagatactgagttttcctttgcctcaaaatatgcagctaccctgccgcattttttatcctcaaggaatatgtcaaccagtccctttttatcttcacctcttactatgcgaagcttcatacctgtgaccccgtctgcagtctctattggtacaatatagttttcctgtctcgacatatttgaagctatccttagctgactgcataatagcttcatctgtctgaggtctattgagcctgtgtgcctatcctctataatcatcgaatccataacatgctctgctgtatcagccagcgtttcctgcgcctgcgcaagctcctttggatttttgaccgactcagaaaatcgtctgagagtctcatccaaaagagcccttgccgtagcactgtctccacgctcccagagatttcttactgcctctgacggatttttcattagccgtgacgcagccatgaggtttaccgcggttgtttttacatcatatttttctagaaaagcatatacgttctcaggcaccgaaactgcctgattgaactgtcttagctgttctgtggcatattgctctgacagtgcgttatcctcgttggcctcatatacagcctgccttaactgctccggagtcatatcaagccagctgtcatactgcacaaactccattttctcaggtgaaagtgtatcaagcacatcccttaggcagtttgtatgatatgcgctttctatctgtgagtcaattttaatgcccctgcttacactgtcaactccggcaaaggtatcgtccaccttatagtccatggcactctttcctcgtacccggaccgctgtaagcagatttttcattgtaatatctgctccctgattaacaagtgagcctatcacagcaccatctgactgctccacctgtgaaataagcctgtatatgcctatatatgagtctctttcttcctctgaaatttcatttttcttttcaagcttccagagaaactcgctgaatttctcatccctttcgtcaggattttctgattttatccgtctggcagtttcacttatgtcactcatgctcatatcaagcggtgatatgcctctttttatcatctcaatcgtcaccgccggtgtcatatcactgaatgctctctgcacctgctcatctacagactttatctgctttatattgtcctctgtgatgtcggtactgttgtacgcaagtatccgcacagccctgcgattgctttcagatgtatctatctgaagctctttaagtatatcatccacattctgaaatgcttttgatatactgtctcccatatctgcccgcggtgatgtcataagagtctcatatcctgaggctgctgcttctaatgactgcttcattgctttgcctgctgtatacagctcatacacagtgtcatcagcggattccaaggtcagtacatacgccggctgctgcttcatctgattgaaaatatcacagacattattgtacatacgtaccctatcatcagatgcctctacactgctatcaccaaacagcgctccgtagtatttattttcctgctgcttaagcagctccactacacgttcaataggctctgtgtctattgaaactcctttttttatgagtgaaaggttggcttcagctgtcatggaaagtctcgcttcctcaagctttctttgagctgtcacaagccttgcttcccgactgtctgtaatctgattatccgcagctttattcgctgaggcttgcgatactgcactatccttgccccttgcagctataagctttgacagattctctatcgtgacaggtatgttatctgactctaatgtgacaatgtcatctgcggtcgcctcacctaatacatcacaggctttctttgccatgtcaaatgtcagaccatcttgtgacatagtggcttctgtagccttttttcccattgccagtgcttctgtcactgcccttgcataaaaatcactgctcacattttctcctgctgcattgatgcagtctacctgattcgcaagcagcacattgtcaggtgtaacggctatatcttcatctatcagccatctgcactgattcagattctcatcactactgtctatatgagcttcctctaatatctgtttaagctgtggcttaagctcatcaaacagctcatctgatatctccgtcattttggttttctgcctgtaatcttgtacctgactgctgctgtacgtagccttgtatacattggaaaccgtcggattcatgttatttctgaccagatatgcctttgtctcattggatatatttgtaaggctctttgcccggtctatggcatctgtacctgcctttatattgtcatctgtagcaggaatatcatattctttcatctgattgacaagcatggccgcttcagtctggcttcccgtgatgtctgtaagctgctccctgctcagatcatctccatatatggatatatctacacctgcctttgccagcactgcttttatcttgtcggtctcagtgacaatgacatcgtagccgtcatcctttgcagctttgtaatcatcactcgtggtggtgcttgcagtgacaatcatatcatttcgcctgttttctgaggtctgattcatgtcatttagcagattttctgccatatctgtgccatcgttgttcccggcttcgtttttagcctgtggtcttgcatatatcgtatccgacatatcaacagaatttgacgaaccgacaacagccgccttttttgacatattgtcactgctgtctgtctttatgtagtctgacacacgcatacccgctgtcatgtcatttatggtttttgtgtccgtatttttcgtatctgtgcttttattaatcaaattctctatctgcatatttcctgctccgtgccctgcatatataccatctctgcagcctttatttatggatattcatacttcgtacttttgtggttctgaatagttatctttttattatatatcgacatataatacacaaaaataaagaccgcgccttaaattggcgcggtcctttaccctgctgtttaccggtatattagtatttaaatacagcaactccgtaaggcgcaagtggataagcaaatgaaaatggtctgccgtcacactctgatttgactgccttatagtccagcttcttatatgtctgttttgctgccttgcctctgccctttgtagccttctttacaggctcttgtaccgttttgccggtaaacttaggatcctcactatctaaaacaagctgatatgtcttgtgctttggaactccgactctgtaatcaggtctctctaccggtgtgaaattgatgacaaagagcatattattcttgccatccttgctctttctgataaagctgaagatgcttctgtctgcatcgtttgcatttatccattcaaagccttcccagcttgaatccagctcatacagacagcggtttctcctatagaggtgaagcagctcctttacccagttctggatctttttatgctccggattctcaagcagataccagtcgagttctctttcctcactccactcctgcttctgtgcaaactcctgtcccatgaaaagaagcttctttccacagtgtcccatcataaatgcatatcctgccatgaggttcttgaatttatccccttctaagcccggcattttgttgagcatagaacacttcagatgtaccacctcatcatgtgacagtaccagaatatatttctcactctcattatagctcatcgcaaatgtcatcttgttgtggttatttttacggaaatatggatccagcttcatataatcaaggaagtcatgcatccatcccatgttccacttgtagctgaagttcagtccgtcttcctctaccttgcctgttacctttggccatgcggtagactcttcggctatcattacagttccgtgatttcttccaagtatgagtgtattgatatgcttgaaaaactctactgcctcaaggttcttatttcctccaaacttgtttggcacccactgtccgtcgttctttccataatcaagataaagcattgacgcaactgcatccacacggagtccgtctacgtggtaattttctatccacatcagtgcacttccgataaggaagttctttacttcattcttaccgtagtcaaatatctttgtgccccagtcaggatgctctccctttcttgggtctgcatactcatatgtggctgttccatcgaaattggcaagtccatgcgcatcctttgggaaatgtgcaggtacccagtcgaggattactccgatattatttttatggcactgatcaacaaagtatgcaaaatcctcaggctctccatacctcgatgtaggtgcatagtagcctgtcacctgatatccccatgagccatcaaacggatactctgaaatacccataagctcaatatgtgtatatcccatagtttttacataggatatgagtgattttgcaagctccctgtatgtataaaagccctcatcatccctgcccggatgtctcatccatgagcccggatggcactcatatatagccataggtgaagaatatacatcagcatctgactttgctgctctcttatccatccactctttgtcagtccatgtgaagtgctcgatatctgtgatgattgacgctgttcccggacgaagctctgcgtagtttgcatatggatccgccttgtacagcttatcaccctgttcagtgactataataaacttatacatctgacccttttgcgctcccggtacaaaaagctcatacactcccatggtttccggctctacacgcttcatctcatgactggtctcattccagtcattaaactcaccaaacacgtatacttccctcgcatgtggcgcccagacgtcaaagcacactcctttttttcctttgcgctcagctaagtgagcacccatcttcttgtagatatcatagtgtgttgcctgaccaaacaggtaacaatccattgctgtaaaattacacatatatatacccccataagtatttatttttccctgaaatgatcctctttgagtacaattcggtcatcatctgtatatcgcctggctgtcagaatacttatagccttcttaagtccgctgtgagcctccctgtctatggcctcgtcaattatatccttgacctctgtcagagtggtagcctggtctatcctctcaatattgctgattctgttatgcaatgccagaatagccatctcatctatcttgtacccaagctctgcagagtacgatttggcaaacaatacgagttcatcatttgtaaaaataggaaccgatatcttttccgtgaacttggatgcaaagccctcatccattgagagagccttctttataccctttgatgtatcctcaagtatatagagtgttcctgtaatatcatgctccatcaaaaatgatagctgggcagctatgctgcggtcgatatcaccggctctttctatgatgagacagcctcctgttatctttctgactacctgctgcacatcctttttattgagtgcggcagcatcaatcttgcccatctttcctgtaagctgttcaccatctttttgtaatacctttataaagcttgtagcaagcattgtctttccgcaaccctgctctccctgtataatgaggttgcctgtggatgcgttttctttcctgttgaaatgatcaagcactgcattatatgccttgcaaatctgatcctccataccctttaccggtatgaaatatgaaaatatagctttctgttcgcttgtaagctcttttatatgttttgtttctttcaatttcgagtcatcttcttcgctgtctaaatcctccggcaatgaaatatccggcatttttcttgtcttagccatatccagcttcttctccagtcccggattctttgctgtcatcttggctatttcctgctcgataaatgatgtcacatgatcaaaatctctcttctcagaaacgttttctttctcctgtgaagtctcatcatctgatgtatcatcatcgacatttaacatatcatctgttatttcaggcatcatggtagtcggctgcatgagtatctcgtctttctcagactcctctgccataattatatcctccggctctccaaccggttccctggcttcatctgcagcctcttcaggtacttcccgtgactcctgcacttcttctatagcttcttctatagcctcttccggtgcttcctgcggctcctgtgcttcgtctatagtatcttcaggtgcttcctgcggctcctgtacttcatccacagtctcctctgcataaagctcctgcatatccggtttctgctcttcttcaggctccttcacggcagctttctgctctataatatcaaccgggaccttcaaatactcctcctcaagaagttccttcggagtgacacctgcatccagctttggaatgacatcatttagtctctccatgatgtctcctgcctcctgaagtgctcttgccttagctgactcaagtttctgctgctcagcctctttaagtgcaatttcagccgcatgtctggtcttttcccattcttcaagcacatcctgtatagacatctgtcctgtaatctgatgctcaagctgagtcttttcactcatgaccatagacatctgtccgtcagcgtcttcacccaaaagctccttgaaattcaacttaagtgaaccatctatctcttcatctgtagcgatatgctctgtctcttccggctgctgtacatactcttcctgctccttttcgagcttgagataaggaatatcctcaactatctttttgatggtatccatcgtatcagcaacttcattcttgcccttggcctccatgatctgctgcatacccttggcaatctcctgctgtaaatttacagtattgaacttctcctgatttacagtaatctgcggaatagttacgtcatcatgcactatctctccgccctttaccatctccatggcacctatctcagtgacctcagcctcatcatttatcttagccggcttttccttctctgccttgaatcgtctgtacttttcctcctgagccttggtaagtggctgataaagcatcttaagctccagcgcacgctccacatatggtccgtctccgaaccacagaatgagctcatcgcaggcatctatacacttatcggcttttccggccttgtggtatagatatgcaagctcgtatgcccactcctcagtgtattcttcatccttgtactcttcaagaatagtgataagctcatcaaatgaagctccctgcccttttttgatggcatatcttaatacatacttcatatcatcatgaggcgctatctcaacaaactcatcataatactctgtagcagcatcataatcacccatcttgatggcgacctcagccagtctgtatataatcatcctgccgattggtgaacggtcataggccattaaaagtatgtcccttgcatcctggtatctttcggccttctcgtagatttcgccgattttaacgagtgtatttacatttttaattttgttccaatttatgctatccgcaatctctgctgcgctcatatagccctcctcggcgcttagggcttttatctgatccagcttgagattgtattcgtatttatccacttatttcacctactcgtatttaagcttattatttttggtatctacgcctgttgtctttgtataatcccttgtgtcctcaggaagcttctttttcctgagagcataattaacaactcttttcacaatatagtatatcacagcaaaggttggaacaccaagtaacattccaagaaaaccaaacattcctccgccgattagtatggcaaacataacccagaaggtcgaaagaccggtagatgagccaagtatcttaggccctattatattaccatccacctgctgcagcacgacaataaatatcagaagataaagcgcatgccacggactctgaattactactatgagtaacgatggaattgcaccgataaacggtccgaataccggaatcacatttgtgacgccgataatcactgcaacgagcaccgatgatggaatccttaaaatcagacatccgaaatatgcaatcacacctataatcagtgaatctataatcttaccgcttatgaagcctccaaaaatctcatttgtctttctgatcgtctcaatgatgatattgcctgtctttggcttgcagacagcatatattatctttttgctctgtcctgcgagagtctcctgaatactcatcacatagaccatcacgattattccgataataaaattaagtaagcctctgactaccgaaatcacaccggttgtaatctgtgcaacatacttctgtgcctcaggaatcagcttttctgtggcataattctcaatgtagtcggttgcattctgtaaacctgtgctcgcgagctcagcaattttgctgtccccgaaattgccgttctttatcatgttaatgaatgccgcaacatcatttggcagtgtcttcataagtcccgatatacttgctatgacagaaggcacaatagccgcaatgaggagcgaaataatcgctaccagaataataaccgagcctgtaattgcaagagctcttgaaacctttcgcagcttgctttcgcttttcatctttttggaaagaagctttttaaagcatctttccagccacagcatgacaggattcatcaggtatgcaagcacaagtcccattataataggcattgctgccgcaagcagcttgctccatatgcctgcaaagccctcaaatctgtacagtgcaaagaaaaacagtatactgactgcaaacgtgacaaataccatgacacctattctgatcagatgtggccattcctcacgccccgggtgcgaattctgcttcgcacccttatctgcatttatctcaatgtttgattttttaccagcttttccggtttcttccatcggattaaactctccttatttacgattatagttgatgagacatccctttaatattatctctctttcatcatctgtgagctcacccatcttcagtgtaaatggctttaattcaccatccttgacaacatatgcctcaaactccgtctttgcatcctcgatttccttcttgattcccggaaggaagatatagtcgaggttgtggaacggaagctctccctcatcgatgatgaatggaagcattccccagttgataaggtttgaacggtatctctttgtagcatactcgtttgcgatatttgcccagcctccgagtaccttctggcagctggcagcctgctctcttgctgagccgtcacccggcttaacagcaaaaattgtgcttccgaagcccatattctcatggcttgcctcagggaattttttctttactactcccatgatttcagcaacctcaggaacagcctttcctgcgcactcaccactctctatagccttctgggccttctggatttcctttgctctgcctacatactcaggatcctttcttgaaagtgcgaactctgcaagtccaagagggtttgaacgatatgaagatgtctctcctgaaggaatgagctcatctgttgtagtaacaggatcatgaatctctgaaaccaccttaaggagcatattctcaggaagcgcgctcattgccggccagtccttgatgtttggtccgaactggatttcaactgaaggatctgccactccatggctgtcaaatacacggttctcatatatagtcttgtcaaagaaatattttggctttgtaaagttgacatcaatatccgctgctgatgtaaggaagcccttgtttgctgctgttgcagcgattgaacgtgcatccatgagtgccactgagctgatctgtccgttctgtaccttagaaccctctctgttagggaagtttcttgttgaatgacggatagagaatgcgttgttggcaggtgtatctcctgcaccaaagcaaggtccgcagaaagcagtctttacgattgcacctgtctcaagaagctttgctacagctccgtttttcacaagctccatgtatattggagtagatgccgggtaaacactcagtgtaaactcgtctgctccgattgaatgtccgtttaatatgtcagccgcatcgcagatattctcaaatccaccgcctgcacagcctgcgatgattccctggtcaacatacagttttccgtctcttaccttactctttaaatcaagcttcaccttgccgtcaaagcttacctcagctctcttctcacagtcatcgagaatatccatgaggtttgcattgagctcatcgatagtataggtattgcttggatggaatggcatagctatcattgggcggatctggcttaaatcaatctcaatgaatctgtcgtagtaagccacctcacccggattaagctccttgtggtcctcagccctaccgtgaatctcaaagaattccttaacctggtcatctgttctccagatagaagaaagacatgtagtctctgttgtcataacatcgacacctatacggaagtcaacgctcagattagacacacccggtcctacaaactccataactttgttctttacgaagccgtttccgaatacctctccgataattgcaagtgcgacatcctgtggtccaacgcccttgattggctctcctgtcaggtaaatacctactacctcaggcatatcaatatcatatgtctgttcgagaagctgcttaacaagctcaggtccaccctcgccgactgccatagtaccaagtgcaccatagcgtgtatgtgaatcagagccaagtatcatctttccgccgccggcaagcatctctcgtgcaaactgatggataactgcctgatgaggtggtacatagattccaccgtacttctttgcacatgtgagaccaaacatgtgatcatcctcattgattgttccaccaactgcacaaaggctgttgtgacagtttgtaagtacatacgggatagggaatttctcaagtcctgaagctcgtgctgtctggatgatacctacaaatgtgatatcatgcgatgtaagcttatcaaacttaatctgaagcttgtccatattgccggatgtattgtgctcctttaaaataccgtaagcaattgtctcctgcttagctgtctgtttatcgatgtccatgccggtcttgcttttgacagctgcctgagcctctggtccatcaattattacttccttaccgtttaaaaggtaagcaccattttcatataatttcacttattctacctccgtatgtgtatttcaaaattcttttatttactattatataatattataggtaattgtggcaataaataaatcaccatctaccttaatttcgaattttcctcccatcaaatgggtcagattctttgcaatcgaaagtccaagtccacttccttcagtggttctcgacctctctcccctcacaaaacgctctgtcaggtctacatttccgttgcttactatgtcaagctcgttcttagacacattctttattgtaaaaactgcctttttatctgccttttcaagttctacatacactctggtattttccagtgcatattttgcggcattagtatacagattttcaatagagcggtaaagctgacgcccatccgcatagataaatatctgttctgatggaatttttgtaactattgtcagatttctcgactcaaatcgctcattgaattcacctccggtctggtataaaagctcaaccagatcaagcttttgcatattgagcttcacatttcccgaggtaatctttgatgtctctaccaaatcctctgtaagctgctttaagcgctgtgacttttcctccagcacatgtatatagtatttggcattttcattttccagattttccctcttaagcaggtcaacatagttgactattgaagtcagaggtgtctttatatcatgtgatacgtttgttattaggtctgcctttagtttttcatttttaagactctcatttaccgagctcataagaccctggcgtatatggttgacagcctccgccacctttttctgctgcccatgaaactcattgacattgagtgtagtgtcaagcgctccttccgagatagcttcaagtgcctcctgtatgcgcattatctctttatttttttgtgtgtggatatcctttttctcaataactcttttcaaaagctcatagcccttgtacatcaggctgtgtgtgtaaagtatattgccttttatcttccttacaatgctctggtataaaataataaaagccagatcaaacaaaaaagtaaatgtgccggccgtcataatgagtgatgcatagtcaaaatgctggttttttacgcctgaaatcacttttcccataaataccatgagcagtgtaaatatcactagcatcacatcagagtataccttgtcaatcggtaaatagtatattgtgtaatcatcctctgattttctgcctgccacgtttgccatatatgccaggctcacaaagctgcctaccaggcccgccagcgatattagtgtatatatatcaatattttcatgcgcatcgtgcctgaatgcatagcctgtggcaaacactcctgtcaccataagtatcatgcatagctgatgtaagactatgaccgctgctttttttcctatcgtatactgcttcatttgttgtcctctatcttatagcctactccccagaccaccttcagatagcgtggctccttaggatttatctctattttttccctgatatgtctgatgtgcacagcaactgtattgtcggcgcctatcgcctcctcgttccatatactctcatatatttcgtttattgagtagacctttcccttatttttaaggagtaaaagcaggatattgtactcaatcggtgtgagctttacctcctcaccatccacagtcaccttttttaaatcatcatttaccaaaagacctccggcctcataaaccttgtctccggctgcatcattgcttgacagagtggtatatctgcgaagctgtgactttacccttgccacaagctcaagcggattaaaaggctttgtgacataatcatcagctcccacattgaggcctaaaatcttgtcagcatcctctgtctttgccgatagaatgattatcggcaccctgctttcctttcgtatctgcagagtagctcttattccgtcgagctttggcatcatgacatctattatcatgaggtctatttttttattcttcataatttcaaccgcctgtatgccgtcgtaagccttctccacgtcgtagccctcctgcatcaggtaaatctcaattgcctcaactatttccttgtcgtcatcacaaactaatattgtcatattatcctccttctatgaattttgaacagaaaccttctcctgccgttagtcagctatattttatcagattatccactttgtttttcttaaaatctgcttaatattacccactttaaatataagccaaaaagcagccgttctgttttgaactgctgctttatattacataggtgtgtttcatttccctttatttccggtgatgctctgccacattctgtggataccgtctgtgagctccttcccttcctttgtgttgataacaggtggattgccggcttttctgcttattgccttataatcctcatcaacagacgattttgagccggcagccttggcttcatccttatcattgctatgatttaatccggcatcaggtgtatcgtctgcaagcttcacttcacccactacaccatctcccaggtcctcgccctcagcaagtcccagttttctgatataatccatatttaccttgatttcagtctgtctgtttgcatagatggacttctcttcattgtcaatagtacgctcctctacaggtttacctgcatttttctgacgttctatctccttatttctgtcatcgataatcttaagatacttctccgtatcggacaaatcctgaagctgtcccttgagctcatactggttagttttaactatcttctcctgctctgcaatcttatccttcatattcttgcacagcttttcaagtgactcgttggtatcattgatgatatcacgcactcttgaaagcgcctcatccgtatagataaccgatgctgcatacacatcctcagcctttctgcttgcatcccagactatctgatcccctttctttctgaactctctctctgcgtgattgcgactctgctcagtaagctcatactcatcctgtattgcatatatacacttattcagctcagcaagtaaatctatcatttgctgcttgtttatgatcaccctgctcggctccggcttatacggctccgcctttgagagcatgatatgaatttctcttagtaccttttctgttttatcgttcgcattcattttctatttcctcggatttaaattaacattataactattcagggtggttatgaatactcaccacttacccatattttatatgaaaatccgcttctcgtaaatagccaaatgaataataatagttactataattaaatcaatcccgctgccgcatttctcagttcatctgccgcatgctttatctcggcagcctgctcttcgctcacatttccgggctttgtccttgaaataagcttcttcacatatgaaagtgacgatttcacactctttttctgtgcgctgtccatagcctttcttttttccttgtcagccatgacattttccacctggcgcacaagcgtatcagcctcacttcttgcatcaatataagcctttctctgtccgtctgttgcctcatactcctgcgcctcacggatagcctgctcaatctcagaatcagacaaatttgagcttgcggtaatcgtaatctcctgatgctttcctgtgcccaggtcctttgcagaaacctgcacaatgccgtttgcatctatatcaaacgtcacctctatctgcggcacacctgccggagccggcttgatgccctttagcctgaagtttccaatcagcttattgtcccttgcaaactgcctctcaccctgcagtacctttatatccacagaggtctggaagcttcctgcagttgtaaaaatctggctgtatctcgtaggaatagtcgtatttctgtcaataattttggttgagacaccaccgaccgtctcaattccgagtgaaagcggtgtgacatccatcagtataatctctgccgcactgctgcctgcgacaattgctccaccgagcttgccgccctgtactgctgcaccgagtgccacgcactcgtcaggattcaggttgtgtgaaggctcttttcctgtaattcttctgacctcctcaacaacagccggcacacgtgtcgagcctcctaccaacagcaccattccaagctctgctgcggaaatacccgcatctgaaagtgcctgattgacaggaatagcagttctctccaccagatcctttgttatctcattaaactcagcccttgtgaggttcatctccatgtggaccggctgtccctttacagtggtgataaatggcaggttgatagtggttgaggatgatgatgaaagcaccttttttgccttctcagcctcctccctgacacgctgcatagcagtattatcctttctcagatccacattctgctgtctgtaaaactctgtgacaagataattcgtgattctctcatcaaaatcatctccacccagatgattatcaccggctgtggcaagcacctctatcagattgtcccctatttcgataacagacacatcgaaggttcctcctccgagatcgtagacaagaattttctgctgctgtccatggtccagtccgtatgcgagtgccgcagaggttggctcatttatgattcgaagcacattaagcccagcaatctttcctgcatccttagttgcctgcctttgcgcatccgaaaaatatgcaggaactgtgattacggcgtctgtcactgcctcaccaatatagtcctctgcatcctttttcagctttctgagaatcatagaagaaatctcaggagctgaatacagctttccgtccacttttgccctgaaatcgcttcccatctgtctctttattgagaaaaatgtcctgtccacattgactgctgcctgcctctttgcagcctcgccaaccagtcgctctccattctttgtaaaagccactacagacggagttgttctctgaccctcgctgttagttatgactaccggctgattgttctccaatactgccacacagctgtttgttgttcctaaatctatacctataaccttgcccattttatgcctcactgtttttttatttaagtctcataaataattgatttttttgacttactatttcatcctaatactactttaagcttggaaaattcactcgtcaaggcatgaggctgttatttcagagaatgtttatacttttaatttttatatcacaacataacaacaaaggcaccaccgaagcagtgcctttgttgattagtttataggttggattaaaaaatgataattgaggattgcttattcacttactttctttttgagtaatccgagtaatccacatgcaatgaaagatccgattactaatgcaacaagatacattaacggatttccgattgtaggaactacaaagattcctccgtgaggtgccatgagtgtacatccaaatgccattgaaagtccacctgccactgctgaaccgactacacatgccggaaggacatgaagcggatcagatgctgcgaatgggattgcaccctctgtgataaatgataatcccatgataaagtttgtaggtcctgcctttctctcctctgctgtgaacttgttcttgaagaagattgttgcaagagcgattgcgattggtggaaccataccgccaatcataactgcggccatgatattgtagtttccggcagcgattgaagctgtaccaaatacataagcggctttgtttacagggccacccatatctactgacatcattcctccgagaagtactccgagcactactgcgcttgcaccgttaagtccattaagaccattgttgatagctgtatttaaagctccgattggaggctcaactacaaactgcattataacgcctaccaggaatataccaagcagcggataaagcagaaccggcttcataccatcaagactctccggaagtctagaaaataccttctttaagagaagcacaatatatcctgcaacgaaacctgctacaagtgctccaaggaagcctgatgtaccgtttgctgcgattgaaccgcctacaaaaccaactgcaagacccggacggtcagcaatactcatagcgataaagcctgcaagaattggaagcataaatccaaatgctgttccaccgatttccttaaacattgctgcggcctgtgtaatagtaccgaaatttgctctctggtcagccggcagtgaattaaggtcaacactgaatccatcgataaggaatgcgattgcgataagaataccaccaccaactacgaatggaagcatatgtgaaacaccattcatcagatgcttgtaaatctgatgtccaatgctctcttttccaccaactgatgaatgtgaagcctcttttttacctgatgccttaaatacaggagcatcaccagcagcaattctctttatgagctcttctgccttattgattccgtcagaaacctgacactcaataaccttctttccgtcaaagcggtctgtaggtacatttgtatcacaggcaactataacacctgcagcctttgcgatttcatcatctgtgagcacatttttggctccgcctgagcctcttgtctcaacctttacctgatatccaagctccttggcttttttctcgatagcctcagcagccatataagtatgggcaattcctgtaggacaggctgtaactgcaacgataaatacatcgtccttcttcacctcaacaggctctttcgcctttgcctctttggcagcctctttctcatcctttgctttttcagcgctatcgatgatatttaaaaactcatcaactgaaccggcattgataagagaatttgtaaactgctcgtccatcagcataacagagagcttgctaagcacctgaagatgcacattatcctctgtgtttggtgcagctataaggaaaataatctttgcaggtgtaccatcgagtgattcaaagtcaaccccatcctttacaaccattgccgcaagacctgctttagtaacagcatcagacttacaatgaggaattgctatacccattccaattcctgttgtgccttcctcctctcttgcaaaaacacccttgcgatacttctccacatcggctattttgccactttttgccatcaaatcaatacactgattcaatgcttcggtttttccggcaggcgtaccatttaaattgatactctcagctgccaacaaatccctgattgtcatacatcattcctcctaatagaatatattaattatttatatcaacctttttgataccgtttgtttaattggaagcactgtcccatttatcaataagtgcttcaacctcaggctttgtagcaagctcctcagaaaatgcacttgcacttcccgtacatacgccataaataaatgcctgcttataatcatttgatttgaggtatccgtaaacaaatccggctaccatcgaatctcctgctcctacagaatttttgagctttcctttaggtgcatttgccttaaactcctgtccatcctcagtcacaagcactgctccgtcgcctgccattgaaacaagcacgtttcttgcgccctgctcctgaagcttctttgcatactttatcacatcgtccttgtctgtaatctcaaccccgaatatctcaccgagctcatgattgtttggcttgatgaggaacggcttatatggaagcacgtttgtgagcagatttcttgtcgcatcaaccacgatatttattccgcgaccctcaagatgcttcatgatatccatatacattgatgaaggcatcacatcaggaatacttcctgcgagaacaagcacatcagactcctttaagcagtcaagcttctcatagagttttttaatattgtcctcagtgattgcaggaccctgaccattaatctcggattcctcatttgagcgaagcttcacgttgatacgtgaaataccatcctccacctctataaaatcagtatcaacacctttttttgctagaagtcttttaatttcatttcctgtaaaacccgctgtaaaaccaagtgaagtattgctcattccaagattcttaagaaccatggaaacattgatgcctttaccacctgcaaaaatcttctctccagtcgttctattgactactcctgtcttaaaatctgttacatcaacaatataatctaatgatggattaaaagtaactgtgtaaatcatgttagacctccttaatatttttatatttcttatagttgtcattacttagtgcatttgtaataattacagcatcttcaaaatcagcaaacttgatgcttgatacctgtgaaaacttactgtcatccgcaagaatgtatttctccttgctattctccatggatttctttttaaccatggcctcctttatctccggagtcgtaaatccattcttcacagtaattccgttggttccccagaagcccttcgtaaaattatatttatcgagcgtcacaacggcctcatctccgacaatagcctcggtagtagacttgaactcgccacccagaatatatactgtatatcccctatcggaaattctcttggcattagtcagagagtttgtaacaaaaaccacattctttgcagtaatataatcaatcatgactgctgttgtagtaccggcatctatataaacaaaatcattatccacaataagtgatgccgcatatctggcaatctgttccttttcgctgcgattctgcttaagcctgttgataaccttctcatcctgagtatggatattcgtattatttacaatcgcaccaccatgtaccttggtgagataacccttcttgtccattgcaaccagatcacgtctgattgttgactcggatgtatcaagctcatccataagctgctgaacagtcacacttcccatcgaatctaatatatcgagtatttttttgcatctatcttctgccagcatctaatcaccccagtttatcaaattattcaaagacttattttataagccatttatttaatgcttattttcaaattactgtattaaacatttcaacattcatttaacttgtagtataattatattttcataatccgtcattgtcaatcataatcagtcatttatattcacaaataatcacactaaaaattgttgaaaatatataaagcaagttttaaaattgtgcactatatgcaaatacaacattgattttagtgcagaatataacatatatatcattaatacttgcctaattactaattttagtatcttttctattactaatttataatctaaaatatagttcaaattaactaattttaatttagtcactatcaaatttgactgtttttgactgttttgaatctaaatgcattgtaattcataattcatcatgctagaatatgttcattatggtacatattttatgattaaagggtcaaaaggtatcatcaatgagtttatattttgttatttcacaccattttaaataatttatgtaccatcacagctacaatactttaagttaaaaaggaggatttcacatgaaacagcttaattgggcaacactcggctgcggcgtaatagctaatgagctcgcgcatgctctctcaaaggaaggacgcactctttattcagttgccaacagaactcatgaaaaggccgtagcttttgcacaaaaatatggcatttcaaaggtatatgacaacattgatgacgtcttttatgatcctgatgtggatatcatttacatctccactccacacaatactcacatcaattatctaagaaaagccctttctaatggaaagcatgtactctgtgaaaaatctattactttaaatatcgcagagctcgatgaagccgtctcactggccaaagaaaataacgttattcttgctgaagccatgactatatatcatatgcctgtttataaaaagctaaacgaaataattgcaagtggacaactcggcaggctaaatttaattcaggtcaattttggaagctacaaggattacaatatgacaaaccgatttttcagtcgtaagcttgccggaggagcattgcttgatattggagtttactcactttctcttatccgctggttcttcaaggaaacaccaacacaagtatcgtcacaggttaaatatgcaccaaccggtgttgatgaacaggcaggtattctgcttatgaatgatgcagaggaaatggcaactgtcacattatctcttcattcaaagcagccaaaacgcgctacgctctcttttgacaaagcatatgtggaaatctttgagtatccaagaggaatgcaggcaactattacatatacagaggatggtcataaagaagtaattgatgccggtgatacatcagatgcactgtattacgaagtacgtgatatggaaaaagctgtaagctcagcatcatcagatgaaatagaaaccctcatgcactgtcaatatacatatgatgtaatgaaaattatgtcagatataagagctgaatggggtatgaaatatcctgaagaagaaaaatagatttgtatgttcactgttatagttatattataaaaaataaatagttgttaaaaaagcaatataattctgattatcagttttatattgctttttgtatataaaagaaagaccacatcataaactgatgtagtcattttaagagaggtgacagccggatttgaaccggcgatgacggtgttgcagaccggggccttaccacttggctatgtcaccatatattatactaaaaaactccccgagtagggctcgaacctacaacaactcggttaacagccgagtgctctaccattgagctatcgaggattattaaggtttgtaccttcaaaacttcatacaaatccgatttgtttttcttcgttattaaccagattaagccctcgacctattagtaacagtcagctccacatgttgagtcggggtgacaggattcgaacctgcgacctcctggtcccaaaccaggcgctctagccaagctgagccacaccccgatatgctgttttgccgtttcgtttttgttgcctcaccgaagcgacttcgatataatatcaccctattccatacttgtcaacacttttttacatttttttgaaattaatttttcaaatacgatacatccggcgtttaagataatatcaaataattctatgaatttacactgctctcaaaccctgatatgtagaataacaagattagtaatgtttgttacccctatgaatttacactactctcaaactttttcttttatatccttatctttactatcgtttgttacccctatgaatttacactgctctcaaacaaggttatgtggttgattgcgtatacagatgtttgttacccctatgaatttacactgctctcaaacgcttcattctacgatgtagaccaagctgatgtttgttacccctatgaatttacactgctctcaaacctcaaactgtccaagaataatcatctgcctgattgcataaataacatagaccgcttatatcttaacatattatgcatttatccgcatctattatataacgtttttcatgctctataattggatattcactattttccaccattaataacttatatccacgtgcgactacatcattaacaaacttgttcatttcatcatctgaaatataactccgcaaattcaacgtaataaacattttttcagaatcgtactctcttactaattccatataatccaatattttttctgcaagtgaatcataattatctgcaaattcaacgcctactgctctaatgacttcgatatctgaagcactctgttatgatgcgataatataattttcccttcttcacctctgagttgacttgttaaatcacataaaatttgatataacagattttgattttccacaattaaactacaacattttccgcattctcatactatcactaaatcgactaaaggaatcgctaatttcataaaatgccccccctctcctctgaatcaataacattacttgtattttcgcccaccacataatccatttttacaaactgtttttctgtaatggtgagtatttgtaccagtccttctgctggcttatttttataaatcaaatttttcactgaattttccactgacgggctcgtaatcatcttacaataaacagattcctgtaacattataaaaccattctttataagtaacttgcgaaagcatctataatctcttttttctactatcgttaatgttggtatatccataatttaacgctgcattaaccggaatatctgcactccttgtaaagtccatcccaaataaggcgttaaaataaaccttagccgcatgcccttctctattcgaggcatcagctaactctacctgaccaatatactcatttaacaagtttgcttgactaaaatatccattctcatataaaaattctgcttacttacgtattttttcacttgcaatgtctctccagactatatccttgatactttgctcccactcaatttgcatacgaagctttgctgggttatcatggcaaccatgatgcgggaatatctctgctataggattacgctttgaatcacagaaaataacttttatcttctttccaatcatagcctcaatacatatgcccgtaattgatattgctggattttcaatcagtagtaccgcaattttatcaagtaatattcgctttgtctccagtcctctaataacaagataccccattttataatctaattttgcttgattctctataatcactacacgccaactcataaaagctccaaaatattctgtgaccttctctcccatattccagaaggtgattgataaactattcttacatcattataatactttttccagtttgaaacattagaactgaaattaacagttgccgcactatgttttttcccacctatattttctaaatcgcatcctcctgtcattctcccaaatattgattgtatatttatcaatgttacagcttgttctaggacattcagtttgcaaaatttttctcttccatttttcaaaattgcttcaggtgaatttattcttttgttataaatactgttttccaacttatctaaataaacatcatataatttaatattctcatccacagaaaccgaatcatattgttcatcataaatatagtttgcattgtttttatttttctcaacaaatttctcaatcttctttaaatacttcaccaattcgtatggcaacgataattgcataattggttgtgctgataaacattttcctccaccaccaatacctgtaatgcatacattaaatccatctaacgaaagtactgtgtttattttccatggcttcattcccataggaaaagatacttcatctgctttttttcctataattttctgcaatcgctcttctgcatatttctttgcaaatacttcatctttcaaaaaaagttttccatataataattcaacagacagaataattatatcgctcttttttccaattttatatctcataggagtcaagaacataattccagatttattgtatccaccgtacctttcagtatctaagcctttttttcttggaacaagacctgatgcctttttgcatggcatttgatcaaaaaaacctcctgttttcataaattgatactttgtaaagtgtgcattatttttcttggcatttttaagaaccattggcaacattttttctttatcccaaatagtttttccattacatacaagtgaatgtgaaaatatcgtcttcgtttttatactatattttgaatccaccgaaaaccacttacgattaaatttcatattatatacattgccgacaacaacatttaaatatgcatctgtcgcatgatgtaaatcattatagctacggcatttatataatccaaattcatgtctgaaatcagatacaagtccggcttttacatatacaatctctgtttctggatatttttcattcaaaatttgcgcaatagcctttgtagactgtgatgtttccgttaactgacggttaataaatccatatttttcatcttcattaaatggtgtactacgtgttaatcgtttatatttttcatcacttactgcccccacatgatgccatgtagtccaaatacctgacatttgtttacgtatttccgtcttaattggatatatatcctgttttgctccattttcttccgaaaatacaagcactttattattaattatactatcatcttttacatatgcttgaggataaatatgttcaatatcatatactttagaaccagacatcaatttttctaaatcaatcattttgccactataagccgatttgccaaactgtatgaaataaaggaaaagcttgtcactttgtagtttattatctacatattcccctaaagattccatttgatgttttaattctcttacgtcctcttcatcacattttgcatacagttctatgacttgctgttgtctagtcctagtacgttttccttttaaatcagggttatttgttcttgccatttcaacaaatatctttttaggtacaccaaatgcttttgtaacatccttaacaactgaaagcgttctatagattgttcttttaacagaatttgaaatatacatttcatctaaacgatcatctaatgttttctgttgttctgtataatatttttttctattttcctttattccattagcaaatgtatacttatctgacaacaattccataagattattattggtttcccacatcaaccttaatacagttgagatttcacccgtttctttacacattccttcaaaatcaaccaaaaatttttttgaaagacgtccaaaatcttttattttaatcttacaaatatatttaatatcttcatccgtcaaaaaactatacttatttttcaaaaagagtaaaacacgtcccttatcatcagaatatgaagcacgttcaattatagattcaacatcctccacggataaaatatgattctgtagcagtctatgaaaagcatgaaaagaactgagatttgtatgtatttgttcgtccaaaccacttattaatgcttcttttccaccttctaaatatccattgctaacaaaaaaatctataacatcttttttccttaccctttttttcttttcaaaaatttcattatataattcctgcttcatagccacagaaatttttctgccatcaatttttatattattgatttcatttaataccataaatttctgataatataatgattgtttaggcaacaccgactcttccggcaaatatgtacactgatttgtcatacgttggataaatgcttgctcacttgcatcaaaatcaactttatcttcaaaattccatggaaaaatttttccatcagcttttctctgaatccacgcaaattgtgagttgcaatttaaaggtccaacaaaatatggaatcttaaatttaaaaattgaaataatcttatcttcattagaaatcccgtcactatctttttctttcaaaaacggtaaataattttttgtattttttaatatgcttattaactcatattcgtataattgatgtggaataacgcgattatcagtattcttctgtttaggtaaaaaaagtcttaatgttagtctttcaatcatattatcataaacaactttatcttgttcatcaacagatattccttccaatatcttaagaagaaactttgaaaacttttctacatcagccttctttcccattttttcgtcattttttaattcataatgataagaataagctacataattgtcacctcttatctcgcgaaaaatctcattatatttatgtggaatatatttatgaaccagatatttcaaattagctaaatcttctctatgctgttcatataccttcacctttgattgcgatattagtggactattgttttcattaaccaatatattagcaagtattccccaatcatataaacttctaagagccttaatcaagtcaaaatcatcaccaatatctgccatgacctctgtcattttttcatcatccataccaagtgttattgagccaaattcatcatattcttccttgatatatacatcttttaatttacaagttcctccagctagtaaacgcacaattgcatcttcactataaggaaatccctcttttgccttcttatctggttttctcgtagcaaataaaactgtagacagattgcgatatttttcgttgatccctatattggcagcaagaacccttcctaactcttcaacatttacttctctccaatcacatataatctcattttcctcaaaaaaacgcataaatccattatacacattatgaatatcaaccaagtcagcaatattttctgtgttaatattactcagaaaatgtcccctatgagtcaccaaccaagcacatgctaaatatactaaacgcacatcatgtttgttagaattatatatcaattcacatatcaaatggtgaatagtcggatattccctcatatactgaacatccgtatattctttatcattaaagaaaacatatctatcctctgcatcgtctctccataagccactttctaataatctaataaaaaaccgttcatctacttttgcaatctcatttgcaaaaatctcctgtaataattgaattctttcttgtctgcgatctaaccttcttctcgcggaacgaaacactcttctgtctgctcccaatgctcctgcgtcaaaaatagtactgccccacgcagcatttccatgatatttcataattttatatttatcatctgtgactgcataaccaacagaatcagttcctatatctaagcccaaatatatattttcttcatttttcatttgacaaatcctcttttgtttattatcataacattgtaatttacagttacccctgtgaatttacactgcgagttcaaataaaagttaactcaattcactggttcgtccagccgcacagtgtgtgcattaagacttcgaaagaagtctttttttattcataattctattctattatattcaatcacacaacttatatcaacatgatttttgtataattttactttatatatcacttttattatcataatattattcattttttataaattcattctagtttattacataaaaaaatacgcaataataatctgcgcactttttaaggggggaagtagactaaacagtagtacaacacatcaggattattttcaaataaaaaaatgtactaaatttagtacaatccgaaaagacataaaaaaagaacacttgtgtgtccgaactgaaaacttttattaaattagcactcgtgcatatttctcctttcgttaatggtatgttcatatgtctaattatttcattttgagtacctttaaaaaaatcaagtggcttaaacccagtgtttaagccactttgagagtggactagacgggagtcgaacccgtgtccgaaatacaattccctgtccttctacgagtgtagtttattgtttaacattccctctgccacacgataacaaacaaccttgtggtttcagtagcttcatgatacgcccgatggctcaaagctttgccaacgtcgtttctcacatagtcgaagcctggatcctaaagtgtgagtgctctaggtcagactgctgccattaggcagcgtatgctaaattatcttcagcgtttaattttaatttggccatttaacgcatcgccatacgactcgcttctccagctgcatgtaccccgtcgaaacctttactagcccatattcaatttttttgcggggtacatgcagctacgctccatgttctccgctccgcttcggtccgcccaaaaccaaggtccaccggaccttgtgggccccgtcgaaacctttactagcccatattcaattttttttgcggggtacatgcagctacgctccatgttctccgctccgcttcggtccgcccaaagtcaaggtccactggaccttgtgggccccgtcgaaacctttactagcccatattcattttttgctaaccaagatttctgattttgaaatctctctgtgcctctcgcttttgatccttcttggctatgtctgctctcttatcataaagcttcttacctttggcaagtgctatctctactttgaccagactccccttaaagtatacctccaccggcacaattgtgaaacccttttccttcatctttgatgaaagcttctcgatttccttcttgtggagcaaaagctttttaggtctgagtggatccttgttgaagatatttcccttctcatatggtgtgatatgcatgccatacagaataatctcaccgttctcaatacggatgaacgactcctttatgctgccctttcccattcgaagtgacttcacctcagttcctgcaagtgaaataccggcttcgtatttctcaagcaaaaagtaatcgtgatagacctttttgttgttggctattaatttctttggttccttagccatgtcggtatctcctttcctcaaactgctttacaatactaacacatttttttacaattgccaatatataaaacgcaaattattgtaaaccgctggttcacatttctgtttatttacactatataatatattatgacatctttttcaataaatctatcgcacagcgaccgacaaataacagataatcaaataagtatttttaatatcataaaaaatttcgtcattattgtcatattattccgccggtttaaaatcaattgtacgcataattttgtcagtactgtccacaacaaccttgattttttgtccaagcttgtatctcttattggtggctgtaccggctagctcataggtatcctcgtaaaactcatagaaatcatctgtcaggtctgtcacgcgcacaagaccctcaactgtatttggaagctccacgaaaaagccccactccgtgacacctgatataactccttcaaagcattcaccaatatgatttgacatgtattcacattttttaagcttgactgtttcacgctctgcctcttctgcacgtcgttcggtctcacttgcctgctttgcaacagcatcgagtatagactcatagtgctcccttcggttatcattcatcctgccgcggatattttccttgatgatacggtgtatctgcaaatcaggatatctgcggattggtgatgtaaagtgacaataataattcgccgccagtccaaaatgtcctgtacatgctgttgtatatcgtgcctgtttcatagagcgcagtgtcagtctgcttatcagggattcttcatctgtgccatccaccttcatcaaaagcttctgaagctcctttgggtgtacctcatcagctccaatatgaagcgtatagccaaaattattgataaatgtggaaagctttgcgattttttctgagtccggcttgtcatgtgttctgtatacaaaaggtatttcctgccagaaataatcctcagccacagtttcatttgctataagcataaaatcctcaatgagctttgttgccacatttctgtcatacggctttatatctatcggatgaccatcttcatcaagcacgactttagtctccggaaagtcaaagtctatagaacctcgtttcattctctttttgcgtagaattgctgcaagctctgccattttttcaaacataggcacaagctccttatattcttcaatcacagcggcatccttatctgcaagaatcttttttacatttgtgtatgtcatcctgcggtttgtctttatgactgtctctgcaatcttatgatcgatgacttcaccctttttatttattgtcataatgcatgaaagagccagcctgtcacatccctcattcaaggagcatatgccatttgaaagctctctcggaagcatcggaattactctgtctacaagataaaccgatgttcctctcttaagtgcctccacatcaagggcactgtgctcctgcacataattcgacacatctgctatgtgtactccaagtacataattgtcgccatccatgtataaagacacggcatcatcaagatcctttgcatcctctccgtctatcgtgaccatcatccagtcgcgtaaatccatcctgccggccatatccgcaggtgtcacattctttgccacattctgcacctgatgcatgattttctccgaaaaatccaccggcagatcataagcctttactatagaaagaatatctgtacccgggtcatctatatgtccgattatttcaacaaccttgccctccggctttttaccctttttaccatagcttgtgatttcaaccactaccttatggcccgacatagcaccctttgagcgctcctttggtatgaaaatatctgtgccaaatctggtattgtcaggcactgcaaaaccaaaattatcacttgcctcataggtgcagactacctgcttcatgcctcgctctatgacggaaacaacctttccctccttgcggcgtcctgttgtgacaggtgagattgtaatctcaacagtatccatgtgcatcgcaccatttacatactctgccgggataaaaatatcatcaggctctccctccacagtgacaaagccaaatcccctttgatgcgctgtgaatacgccgactgtctttttgatttccgactttgaatatttcccgcgctttgagagtgttatccttccctctgcctgcaaatccaaaagaatctgttcaagctgaggtctgtcctctttttttactccgagtactatgcaaagttccttgattttcatcggaacatacatgtcatcacacataaagtcgtagaccatcttttttcgtgtttcatatttatctatattactcattatctctccttttcgttgccccatctgatttcaaatgcacaggctttaaataaaatttccaccattgacattttaatcctatgaatgttgattttatatcacatcaacctgcaacgaaaacctcgaatttcatcatctggatgttgatgcgataaaaaagactgccgatttctcgacagtctaagtatttaccatattcccatatttaagacaattgatataataaagaaaagaacaacacatacaattgtcgctttaaccagacgtccttcctttgaacgtcccttgttcttgccccaatatgtatcagcaactccggcgatagtgccaagtcctgctgacttgccctcctggaaaagaataactatagtaattactaaactgacgattataaataataccgataaaacaatttttaaagttgccacgataagacctcctaatttcaattctaaataacagaactaatatactacgtttttattacacagtcaagagttttatactgtatgtaacagattttcacactttatgcaatggatttcattagtttcacgcaataaatgtatcgctatttttcctctttgtgtccaaatctctctcctgctgcattcatagcctttactatgcaaaatacgatgagtgccatgataaggaaattgactactgcggtaagaaacttttcatcactagtattcttcctttttgctctcttcttttgataatctaaaccattttttaatattatacatttttccattttattttacaataaaatacattataatataattaaaaaaagaaacaactttatatttaggagatttttatgaagtgcatactgtataaaaaagcacttccactcatattattatcatgccttttgcttggtgcatgcggtaattccaaaaatgacagtgtatctaaggagcctctttcccatacttctaccgaaaagggcacctgggactctgctccaaaggtgcttactccaactgccgacggcacacaaacctatacatgtgatgtagccagtatcgatgcttcaaacagcggcagcggctatatcatagtgaattatcacggttctaatcaaaaggtcaagcttcagataaccgggcctgacagtgtcacgtacacctttgatctgcatggaggaaatgaagtgtttcctctggttgcttcaagtggttcgtatactgtaaccgtgtttgaaaatgttgaggggacacaatatgccaccgtgctgtcgcaggtgatttctgtctccatcaccgatgaattcggaccgtatctgtaccctaaccagtatgtaaatttcactgccgattctccggctgtgaaggaaggcagctcactggcgtactactgcagcagcgatactgaggtcgtggaaagtgtatacaattatatcatttcaaacttcaaatacgactatgacaaggctaaaaatgtcaaaagcggctatctgcctgatgtggacaaggtctttaccgaaaataccggtatatgctttgactatgcggcagtcatggccactatgctaaggactcaggctattcccacacgtttagaggtaggatatgccggtgaagaatatcatgcctggatcagtacttatataaaggacaagggctggataaacggcatcatcgagtttgatggtacctcatggaacatgctggatccaacatttgcatctaccagtgattcgccaaagaagtttatagcacaaaaaagtgattacattaccaaatacgtctattaggaggacataaatgtctagaaaatccaagattttaagcaatgcagaactttctgccttctgtcagcagatttctcttatcatagcagccgggcttcctacatactatggtgtttccatattatgtgatgaagcacctgataagcagacacgtgatctacttgagcagatatataagccaatggagcttggtgcaacgcttcacagtgcacttaaagatacaggatactttccaaaatatatgataaatatgatacagctgggtgaagaaaccggccgtcttgaagaggtcttaaactcactctcaaagtactatgaccgcgaagacgaaatagcttcaggcatcaaaagtgccgttgcctatcctctcgtgctttctgccgtgatgattgccgttattgtcgtaatgattgccaaggttttacctgtattttcacagatatatgcagagcttggaagtgagcttaccggcactgctgccgtgctcatgaagctcagtgaatacatcaatagatatttgcttgtcattatagctttcatgctctttgccgcactggttctttttatattttttaagacacgcttcggaaaaaagctccttatgaaaactgctctttccatgtcaatcgcatccagccgctttgcaaactgcatgtttttagcactctcaagcgggctcgacacagaccgtggtcttgatctggcacaggctcttgtaaacaatcctgtccttgattctaaaataaatgactgccgtaaaaatatatctaacggcgagacattttcggaggcactgctgcactccaatattttttcaaagatgtactcaagctggattgcaatcggcagcaaaaccgggtctatggacgaggtcatgcagcatatatgtacatcctgtgaggatgacacagatgcaaggctgtcacgattcatatcagtgattgaacctgccatggttatcctgctttgtatattcattggcttcatactagtatcatttttactcccactgcttggaattatatcaagcataggatagcttacggaggcacagtatgctgttttttgttcagaaaaagaaatcaaccatatggaaattcataccaattgtgcttttagccgcatgtaccgttttgtttggtgctttttcttcaaagctgtcagatgacaataccaaaagaagcaagagcacgctggaacgcgccctcacacgaagtatcacacagtgctatgctcttgagggaacataccctccggacataaattatctaacagaccattatggtctcacatacgacagcgactattattacatcgactatcaatacatcggctccaatctgcgtcccgatgtgacaataatagagaggaaataacccatgttcaagctaaaatcaaaatcacatcaggctgacagtttttttgtgatgctgctgttttttctttttgcgctgactgcttttatcctcgtgctgattggcgtaaagcaatacaagtccactgccaatgccatgaattacaactacgaggtacgcactgtcacatcttatctgcgcgaaaaagtcagacagaatgattctgacgctgcaatcagtgtagaaacaataaatggcacgaaggctctatgtctgaaaaacacaataaatgacatcgtgtataataccttcatatactactatggtggttctctaagagagctctatgtacaggatggttcctcatacagtctggacagcggacaaaggattgtcgaaatcggaggacttgacatggcagaaaccaccgacaaaatgattaccgtaactatcaccgatacatccggtagcactaccgatacctactgctccgtcaattccgactaacaatcgtccgacaataaatgcagcaatatcacgtacaccgctccacgatatgccactcgatgccacacaaacttacataccacaaggaataaaccatgatttcaacaaagcttaaacaatcgaaaaacagaatattcctgcttgagattaccattaatctgctgcttttttcagctcttttgattgtgggactgcttttcttcataaagacccacaagctgacagaagaaactcaggtgctgcatgaggctgttaatgcatgcagcaatgcagcaagcgcatacgaacaggagcatggcgatttaaacgccgtatcatcgctttttgacggctccatctgtgcagatgaaaagctattcatttatcttgacaaaagctatcatccatgtgataaggatgatgccgcatacaaggttattgtaagcaggcttgggcaggatgcctacggagtacaaaaggctgacatagagtttatagcagcagacagccactgcgtatacagtattaccgcgtgcagctatactgcactttcctctgatggaaggacggtgagcaccccatgaaaaaaagaagagagttttcaaatttcggtttttcgaccatcctgcttaccttttccatgatatgcattgtcacgttctcggcactcgcctttgtcacagcaaactctgactataagctgagcaaacgcgttgctgataacaacagctcgtattaccgtgcatgtgaaaaggtatgggatgagatatcacagattgatgccattcttgcatccgcctacgatggcagtcctgataaaacagcatactatgaggccataaagactgctctatcagacaacgatactgccataaataaaaacctagctgagaatgaatcaaacggcaaggttaccggtctgacctataccatcacctgtactgtaagtgatacgcagactctcactgtaaagcttgatatcaactatcctgtccacaggcaggatgctttttataaaataaaacaatggaagctcaataccgacacagctttcgaggaaaatgatacactaaacttaattggaggaaactaaaatggatgttaaaaagatattaaaggaagcgactgacaacggagcatcggatattttcatagtggccggccgccctctcacatacaaatcaaagggagtgatggagtgcctcaatgaaatcagaatgattccaaaagaaacctttgaatttgtcacatcaatctatgctcttgccgagagagatatttcaaaattcgaggaaaccggagatgatgacttttccttcgctataccgggagtatcacgttacagagtgagcactttcaagcagcgtggctcttactctgctgtcatccgtgttatctcattcacactgccaaagccaagcgatttacatatacctgactctgttatggagcttgcggaaactaacaacggcatggtgctggttaccggcccagccggaagcggtaaatctaccacacttgcatgtattatagatcagatcaaccatgaaaaggaagagcatattatcactcttgaggatccgcttgagtttttacatcggcatgacaaatgtattgtgtcacagcgtgaaatcaacacagatacagaaagctatctcactgcacttcgcgccgcactccgccagagtcctgacgtcatattgcttggagaaatgcgagactatgagaccatcaatacagctgtcacagcagctgaaaccggtcatctcatattttcatcacttcacacaattggtgccgcaaataccattgaccgaataatcgatgcgtttcctgcttcccagcagcaccagatagccatccagcttgcatctgtgctgcaggctgttgtctgccagaagcttttacctgccacaaacggtgagatggttcctgcttttgaaatcatggtactcacgcctgcaataaggaacttaatccgtgaaggcaaggtccatcagattgacggtatcatctacacctctgcagctgagaatatgattgcaatggatacaagcatcttcaatctgtacaaggccggtgtaatcagcaagcatgtggcaatcagcgaggctaccaatcctgagatgatgtcaaagagaattaatttaaactaacttcatacttgacgaatatataaaaccccggcatataaaccatgaaacaggtttatatgccggggtttttcacttagataaatatgttaatacaagcaaattaccgttatctatacttcgatattatacgttaatctctgcctttactccactctcatccttatgtgcttcaagcacaggattaactacatcacgcagatatacttctacctgacgaggtgcacgtcccacataaagctcaggcttaagattcttttcgatatcagcttttgtcaatccgaatgcaggatctgcagcgattaagtctacgaggttattttcttttccctcttcctttactgtctttcctgcctgcattgagagctgtctgatcttctcatggagctcctgacgatttccgccgttctttacagcatccatcatgatgttctctgttgccatgaatggtatctctgccataaagtgcttttcaataacctttggatatactaccagtccatccaccacattgaggcagaggtcaagtattccgtctattgcaaggaagccctcaggtattgaaagacgcttgtttgctgaatcatcaagtgttctctcaaaccactgtgtagctgaagtaattgcaggattcattacatctgcaagaacatatcttgaaagagatgctattctctcacttctcataggatttctcttatatgccatggctgatgagccaatctggttcttctcaaacggctcctctacttccttaagatgctggagcagtctgatatcgtttgacatctttgtggctgatgcagcgatgcctgcgagcacatttactactctcgtatctaccttacgggaatatgtctggccagacaccggataacaatccttaaagcccatcttctttgcaatcatcggatcaatcttgtctattgtctcattgtctccgtcgaagagctcaaggaagctggcctgtgttcctgtagtgccctttgagccaaggagctttaatgtgccctgcacatactctaaatcctcgagatccagcataaactcattcagccacagtgtggcacgctttccaactgttgtcggctgtgccggctggaaatgtgtaaatgcaagagttggctgattcttatacttatcagcaaagtttgcaagctctgcaataacacttataagctttttgtgaacgagctttaatgcttcattcatgatgatgatatccgtattgtcacctacatagcatgaggttgctccaagatgtataattcctgctgccttagggcactgctgtccatatgcatagacatggctcattacatcgtgacgcacaagcttctcacgctcctttgccacatcataattgatgtcatccacatgtgcctttaattcatcaatctgttcctgtgtgataaccggcttgccatcctgtgaaagcccaagctccatctcagtctctgcaagggcaatccagagctttctccaagtggtaaatttcatatcctgcgaaaaaatatactgcatctctttgctggcatagcgctcagaaagaggacttgtgtatctgtctgtactcatattctctcctttattagcgattaagcatttttctctcgaggtctatttctttatcaaaatactcgcctcttatatcatccttcggtggctccatcggatattttcctgtgaaacagcccatgcagattggcaatccctctaccatctcatgaagtctgtcaattccaaggtagcctaaagaatctgcacctataatctgtctgatatcctcaatagtcctgttgtaagcgataagctgctctcttgcaggaatatctgtaccgaaatagcaaggccataagaatggcggtgaactgatgcgcacatgtacctctgtggcacccgcctctcttaacatacgcactattctgtctgaggttgttcctcgcacaattgaatcatcaatcataacaactctcttgcccttaacagcctcctttaatacattgagctttatctgcacgcttgattcacggcttgactgcttaggcttgataaatgtcctgccgacataaccgttcttgacaaatgctgtgccatatggaatgcccgactcaagtgaataaccaagagcagcggcatttcctgactccggtactcctgtcacgatatcagcctcaaccggtgaatccattgcaaggaatctgccagccttgatacggctgctatacacgcttactccgtcaatatggctgtcaggtcttgcgaaataaatgtattcaaacacgcatctggcctgtttttcaggggcaagtgccatagtcatatcagactcaatgcccttttcaggagtgatggtgataacctctcccggctctatatccctgacaaactctgcaccgattgtatcaagtgcacaggtctcggatgtaacgatatatgcattgtctctttttccgatgcaaagaggcttaaaaccaaatgggtctctggctgcaataagctttctcgggctctcaaccacaagtgcataggctcccttaagcttctggcaggcacgtctgaccgcctcctccgctgtttttgagttaagacgctctctggcgatatgataagctataacctcagagtcgattgtggtctggaaaattgctcctgtatactcaagctccttgcgaagctcctttgcgttaatgaggtttccgttgtgtgccatggcaagtgtgcccttgacataatttaatacgagaggctgtgcattctcacgtgttgatgagcctgctgttgaatagcgcacatgtcccactccgatatcacccttcataggctctaaaatatcaggagtaaatacctcatttacaaggcccatacccttgtgtgtggtcacctttccctttggtccgtgtgtatcactcactgcaataccacagctttcctgtcctctgtgctgaagcgcaaaaaggccataatagatagtggatgcgacatttcctccatcaaaatcatacatgccgaacacaccacactcctcatgaagctcatcaaatacatggttatgctcgtcaatatcagaacacctttttaattttgtaccggtatgactttttgtatctatactagtatttatatactgatttatgttattgtcctggttcataatatctccgtttataattgcgaaatagtaacgcggaataaataatatattagcggctgaatttgcttcctgtaagaagctcaaatgcctctttatatttctctacagtcttcacaacaacctcatcaggtaaaagaaggtcattgtccggatttgccttgagccagtctcttacatactgcttgtcaaatgaaggctgtccctgtccaggcttatatccatcaagtggccagaagcgtgagctgtcaggtgtgagcatctcatcggcaagcactacctcaccctgctcatttaaaccaaactcaaacttggtatctgcgatgatgatgccctttgtaagagcatactctgcacatttcttgtagagagcaattgtataatcgcgaatcttctctgcgtactctctgcccttctcaggataaatcttctctaatacttctactgatttttcgaatgagatattctcatcatgatctccaagatcagccttggtagatggtgtataaataggctcagggagcttatcagactcaacaagtccctccggaagtctgattccgcagactgtaccgttctcctggtagcttgcccagccgcttcctgtgatatatccacgaactatacactcgattggaagcatctcaagcttcttgcagagcatgctgtttccgttgaatctgtcctgaccgaagaactccggcatatcctttgcgtctactgaaatcatatggttaggaacaacatcctttgtgaattcaaaccagaacttagacatctgtgtgaggatggctcccttgtctgtaattttattctttaaaatatggtcaaaagcggaaatacgatctgttgcgaccataataaggctgtccccgttatcatatacttctcttacttttccttctttgaatggtttaaattcctgcatgattgtcctccatcttatgtgtaatttattttacaaatcaaatgctacccttaaattatataccagctcaatttgtaaagtcaacgtatattataagtttttttaaataattttacgtcatttataagcaattcttatatttattattatatctttaatatatcaaaacaaaagctccggttcaaaccctttgtctgcgccggagcctatataatacagattctatttaacgataagtgactttcctgtcatctcttttggctgtggaagtcccataatctcaagcagtgttggagcgatatctgcaagacatccgccctcacgaagcttgtaagaagggtcagcgtttacaagaatgaaaggaacaggatttgttgtatgagccgtatgaggttttcctgtctcataatcaatcatcttctctgcgtttccgtggtcagcacagatgaataatactccatccacatccttgattgcctgaactgcatcacctacgagtgaatcaactctctcaacagcctttacagcagccggaatcacacctgtatgtccaaccatgtcagggttagcaaagttgatgataataacatcatacttatctgacttgatagcctcaacaagatccattccaacctcaggagcgctcatctcaggctttaagtcatatgttgcaacatccttaggactgtttacaagaagacgtgcctcatcgatattcggctcctctactccaccgttgaagaagaaggttacgtgtgcatacttctctgtctctgcgagacgaagctgtttcttgccatttgctgcaagatactcaccaaatgtattcttgatttcttccttctcaaaagcgataagcttgttaggaattgactcgtcataatccttgaagcatacaaatgttgtcttaaggaatgggcgctcaaagccggtaaacttatcatcgcaaaatgctcttgtcatctcacgagcacggtccggacggaagttgaagaagataacagaatcattgtcctttacaacagataccggtgtgccatcctcgtttgtgataactgtaggaagcacgaactcatctgtaacgtcatttgcgtatgactcctccatagcctttacagggcatgtatcttttacgccttcacccttagtgagtgaatcataagccttctgcacacgatcccagttgttatctctgtccattgcatagtaacgtcctgaaagagatgcaatctttcctacaccaatttccttcatcttggcgagaagctgctcgatatagtccttgcctgatgcaggaggtgtatcacgaccatcaaggaatgcgtgtacatatactctgtcaaaattctctttcttgcaaagctcaagaagtccgtaaagatgctcgatatggctgtgaactccaccatctgaaagaagtccccaaagatgcagatcggagtcattcttcttgcagttttcgattgcagaaattaataccttgttcttgaagaaatcaccatcagcaattgcctttgtgattcttgtaagatcctgatatatgatacggcctgcgccgatattcatatgtcctacctcagagtttcccatctgtccgtcaggaagtccaactgcaagacctgaagctgcgccctttacaaaaggacactctgccatcaatttatccataacaggggtatttgccatagctatggcatttccctctttgtggtcacttaagccgtaaccatcaagtaccattaatactaccggtttcttactcatttatatttcctctattcttcatatgaggcttgcaaaatgctctattacagtgacatatgcaagcccgcaaaaaatttcattacataataaatgccactaaatgcagctaagctggtgaatttagtgacatttagttattgtgattgtcaaatcaaatattaaattatgatttaataattacttgtagtttacgatctttccaaaatcagccttgagtgaagcgccaccaactaatccaccgtcgatgtcaggctttgcaaaaagctctgctgcatttcctgcatttacagatccgccgtactggatacgaactgaatctgctgtagcctgatcatagatctcagctacgcactcacggattgcaccgcaaacctcctgagcctggtcagaagtagctgtctttcctgttccgattgcccagattggctcgtaagcgataaccatgtttgcaacatctgatgcagcaacacctgcgagatctgacttaatctgaagtctgatccagtcaagtgtaacaccgctctctctctgctcaagtgtctcaccacagcaaaggattggtgtaagtccagcctcgatagccttctttaccttcttgttgagaagtgcgtcatcctctttgaagtaatctcttctctctgaatgtccgatgataacatacttaacacctgcatcaagaagcatctctgctgagatttctcctgtgtaagcacccttctcctcgaagtacatattctctgctccaacagcaacatttgtaccctttaatgcttctacaacaggtacgatgtcgattgcaggtacacagtaaacaacttcaacatcatctgaaactacgagtggttttaactcttctactaatttaacagcctggcttggagtcatgttcatcttccagttgccggctacaattttctttcttgccattttatatctccttgtatttgtatacaaatatttttttgcctgcggcttaatttcattaagttgctttcggcttatttatcatcagcacaagctacgccaggaagctccttgccctcaaggaactcaagggaagcaccgccacctgttgagatgtggctcatcttatcgccaagtcccatctggttaactgctgcagctgaatctccaccaccgatgattgtgatagcatctgatttagcaagtgcctctgctactgcaagtgtacctgctgcaagtgttgggttctcaaatacacccattggtccgttccatacaacagtcttagctgatgcaacagcgtcagcgaaaagcttgcgtgtcttaggtccgatatcacagccctcacgatctgcaggcatcttgtcataatcatatgtctctgtctctacaggagcatcgattggatttgggaaatccttgattgtaactgcatcaacaggaagaagaatcttctttccaagtttctctgcttttgcaagcatctctttacagtaatcaatctttgtctcatcaagcattgagataccaatctcatagccctgtgctttaaggaatgtgtatgccattccaccaccgatgataagtgtatcagccttctcgaggagattgtcgataacattgagcttgtcagctactttagctccaccaagaatagctacgaaaggacgtacaggattctctactgccttgccaaggaagtcaatttccttctgcataaggtatccgacaacattctctccacccttagctgtgatgaactttgtaacacctgctacagaagcatgtgctctatgagcagaaccgaaagcgtcacatacatatacatcagcaaggtcagcaagctcttttgcgaatgcatctccggcttcctgtggctttgtctcctctttgcctctgaaacgtgtattctgaagaagaactacatctccctctttcatctctgaaacagcctttgttgctgcctcacctgttacgttgtagtcagctacaaatgtaaccttctgtccaagcttagcctcaagagctgcagctacaggagcaagtgactcaccctcgtttggtccgtttttaacttttccaaggtgtgagcaaaggataacctttccaccgtccttgattaatttctggattgttggaagagctccgttgatacggttctcatctgtgatttttccgtccttaagtggcacgttgaagtcacatctaacgagaactctcttgccttttacgttgatatcatcaattgatttcttgtttaatgacataatatgtcctcccttatttcaaggcataagccatgtggccacgccatattatacatattaaaaaatataattaattctacaattcacagatattcaaaagaaatagccatgctttaaaaaagaggcgcggttcaattaagaccgcgccccttgagtagtcttgagatatactgttcttgtgggtacaagaattaagctaactctgagaagtacttgattgtacgaaccatctgagatgtgtagctgttctcgttatcataccaagaaacaacctgtacctcgtacagatcgtcagaaacctggttaaccattgtctgtgttgcatcgaataatgaaccaaatctcattccaacgatatctgaagatacgatctcatcctcgttgtaaccgaatgactcgttagctgctgccttcatagctgcgttgatatcctcttttgtaacgcctgctttcttaacaactgctgtaaggattgttgtagatcctgttggtgtaggaacacgctgtgcagatccgattaactttccgtttaactctgggataacaaggccgattgccttagctgctcctgttgagttaggaacgatattaactgctgctgcacgtgaacgacgaaggtctccctttctctgtggtccgtcaagagtcatctgatctcctgtgtaagcatggattgttaccatgataccagactggattggagcgtacttgttaagtgcatctgccattggtgctaagcagtttgttgtacaagaagctgctgagatgattgtatcagaagccttaagtgtctcatggtttgtattgtaaacgattgtaggaaggtcatttcctgctggtgcagagataactaccttacgagctccagcattgatatgagcctgagccttctcttttgatgtatagaatccagagcactcaagtacaacgtcaacctttaactctccccatgggcaattgtttgcatctgggaatgcgtaaattttgatttccttaccacaaactgtgatagaatcatcgcttgcagaaacctcatctgcatgctcgtatttaccctgtgatgaatcatactttaataagtgtgctaacatttttgggcttgttaagtcgttgatagctactacctcgtatccctcagctccaaacatctgtctgaaagcaagacgtccgatacgaccaaatccgttgattgctactcttactgccattttaattcctcctagaattgtaaaaagtatttttagggacatgccctaagatgcttttattatagcgaataattctcaaaggttcaagtactttatttgcgtttgttaaaattttcactaaatattttcatttacacacattttttatcattcttcacaatttttatttttagatattgcactttattataatctcggctacacttaattaattgctgtaattcgcactttccggcagccagcagcagacaattataaatcatgtaacttataaagttttttaacaacaatacatcagttttacggaggtatttatatgtgggatcagcacatgcactgcatgttttcgggtgacagcgatgccgacccggtattgatgataaactcagcaatcaacaaagggctggacggcatctgctttacagaccatctggactatgactataaagaggagcctgggcttttcgaccttgatatagcagcatatgaaaagcgcatcaaaagacttgcaattgttcttaaagaaaagggctgcccgataaatatccactggggcattgaaatcggtttacagcctcatattacagacaaaaataatgaggtcgccaaaaaatatccgtttgacctcgtgatcggctcaagccatgtagtaaacggcattgacccatactatcctgcattttacaaaggcaagacagagcacgaagcctacaccgaatactttgaatcgatacttgacaatctgcactccggcgcggattttgatgtgtacggtcacatcgactacgtggtcagatacggtcctgacaaaaataaatactattcatatgaacggtatgccgacataattgatgctatattaaaggaaattatctcccagggaaaaggcatcgagctcaataccgccggctttaaatacgggcttggccacccaaatccgaccgaagatgtgctaaagcgctatcatgagcttggtggagaaataatcacagtcggagcagatgcccacaagccggagcatgtggcatatgattttgacaaggtttcaaatatcctcaaggatgccgggtttatgtactatacagtatttgaaaaccgcgttcctgctttcatcaaattatagcccagccttaaaggcttacgttgccattctatctaactattaaacctcacatgcattcgcaaatgtcaaaaataggagccacctgatctacattttacatcaagtggctcctaaagcattggttccgtaagcttcactgtataacctccaagttccgctttcgctatatgaatttgttttggcatttccatattgctttgctataaatctgattctgtttatgacaggattcttattcttttagcttagctatggacctctacccttcttcataaaatcactccttttggttacattatctatgtaaactcttatgagagattctatctttcacttttaatctacaagaactttttcaacgatattatttatttgctaatatatctgtgcgattactgctcttcggctcgccctacagatttaaatattccgttcaatcatccttatagtactttgacttaaattatgtaatccccattggactgtacctcctgtgttttatttttgttcctttcgtatctctttttgttgatttaagattacaccaatttcacctatttgtcaatatattttttgttaattttcatttttattttaaattgtctgatattttatatattttttgttatgtttacacatttcttgcaattcaatcacataattaaagggggcaaaatatctttgccccctcatgccatcatttatcatttatcattcttcatcctgtaatcaatacacctgttcaggtaatcgacataatccggattcttgcacatacccttgcctgccacgtcggaaatctttgccacatccatgccgttacacttggtggtcttcataactatgttgagtgcttcctcatcagtgtcgttactgataaaggttcctataccgaatgcaacctttgccttatccttgaaataatcatacaatgcagtcgcacgctcgaaatccaggctgtcgctgaacaaaagtgtctttgtccttggattgattcccagactgttgtagtgggctatcatcttgtctccccactcgtacggatctccgctatcatgacgcactcccgaaaaaagtgtcgcataggtgagctgaaaatcacgcaggaagcagtctgttgttatggtgtcagtaagcgcaataccgtttaatataccatactccttaacccatgcatcgagtgcgtaccagtttgaatatgccggattatgcttgtgattgccctgtcctgtacacataatccactcatgagccattgttcccaccggctttaaattgaatttcttcgcaagatatacgtttgatgtaccaataaagtgtgaatctgctggcagctcaacctctgcgattgcctttacagccatctcctgcgcctcagcagacagacggcgtcttagtccaaattcactgaaatcgctaagcctgtaggtatcctcctcgagcagacgcaccttctcatcaagcctgcgcttaaactgcttaagcagcacatcataatcatatgccatacggaagtacacttcatttacaatagcaagcaccggaatctcatacatcgaagtattaagccacgtgccggctgcatcgattgccagcccacacggtgcatctgttgtgatggtaaactcctcatatcttggctgccagagtcttaaaaaatcaacatatgtgccctttatccaggtgatgttatcaagatattcaagctcttcctccgtaaaacgaagctgacagaaggcctgcacctgttcctttatctcctcgaccatctcatctgtaaaatgcacgtctttatttctgcacttgaaggtccatgtcgttttatagcttgtgaactgatggaaaatcgtctgtcccatgctgaatttatacatatcagtctcaaggaggctgtttattatttgtggcaatctcatctgttttatgtcctcttttctttcaaaccatttactaccggtaattttagtcttgattttaccactgcgactatcaaatatcaagcagacgcacatgtttaattatcttcaatttattttctttaccgccagcatattcactggttccaaaataaaaactcccatgaaagccactaactgtgacctccatggaagcttaattgtttatattgcagagataataacccaataaatatataagatattgtaattattcagttatgaattatttaaaatatttcacaccgctttcgaatatcttcatatcctgctcgccgtagatattgattgctacagactcgccgcggcgctctgaatgagccatcttgccaaggattcttccgtcaggagatgtgataccctcaatagacatgtatgagccgtttacgttccactcctcatccattgatacatttccgtccagatcaacatactgtgtggcaacctgtccgttttcaaagagcttatcaagccactccttcggtgctacgaaacgtccctcgccatgtgatgccgggttgcaataggtctgaccaagctttgcctgtgcaagccatgggctcttgtttgaaacaacctttgtataaaccatctttgagatatggcggttgattgtattgtatgtgagtgtaggtgactgtgcatcctgctgtctgatctctccatatggtacaagtccaagcttgataagtgcctggaaaccgttacagataccaagtgcaagtccatccctctcattaattagcttttcaacagcctctgtcatctttgcatttctaaatgctgttgcaaagaatttagctgatccctcaggctcatctcctgctgagaatccaccagggaacatgataatctgtgatttgtcgattgcctttacaaactcatcaaccgaatcacggatatcctctgctgtgaggttcttgaatacctttacgattgtgtcagcgcctgctctttcaaatgccttagcactatcatactcacagtttgttccagggaataccggaataaatactgtaggcttagccactttattcttgcatacatagatattctttgcatcgtagagaccgctatttaccttgcttgtatcgtctgttgcctttgtatggaaaacgccctcaagctttgctgtccataccttgacagcctcatcaacaggaagcaccatatcgtcacactcgatggtctgcttatcgtttacatagccgactacagaggctgcatctgaaatacctgctgcatcaattacctctctgacctttgaaagtgcatcaacaggaacctcagctacgatattaccaaagccaggtgcaaagagtgtatcgctggtcacctcatcctcgatggttacaccaagcttgttaccaaatgccatctttgatactgctgctgcgagtccttttccgtcaagtgcatatgctgaaacgattgcgccatcctggataagatttctgattgctgtataaagtgtcataacctgatcatattttggaagatcaaactcatccttatctattgtaaagagaacaagctggttgccctccttcttgagctcaggtgtgatgatatccttttcctttgccacatccactgcaaatgatacgagtgtaggcggtacatcaatatcattgaatgtacctgacatggaatcctttccaccgattgaaggaagtccgaagccaatctgagcatcatatgctccgaggagtgctgcaaacggctggctccagcgctttggatcctcattcattctgcggaagtactcctgatatgtcatacggattttgctgtaatctccgcctgctgcaacgattcttgagatagactcaagcactgcatatatagatccgtggtatgggctccatgatgaaagatatgggtcgaagccgtaagccatcattgttactgtatcacatttaccctttaatacaggaagctttgcaaccattgactgtgtctctgtgagctggtaacgtccaccatatggcatatatacactgcctgctccgatagagccgtcgaacatctcaacaagtcccttctgtgagcatacgttaaggtcttcaagctctgcctcccaggcacccttcatatctcctgcctcaaccatcttggctacagcaggtgtgctgattttatccagataattgtcactctcgcaaggcatctcaacctcaacatctgtctcctgatgagctccgtttgtatcaaggaatgcacgagagatatttactacctctttgcctctccactcaagcacaagtcttggatcctctgtaactaccgcaacctctgttgcctcgagattttcctcctttgcgtatgcaaggaactgttcaacatcagaaggagcaactacaactgccatacgctcctgtgactctgagatagcaatctctgttccgtcaagacctgcgtatttctttggcaccttgtcaagctctatgcgaagtccgtcagcaagctctccgatagcaacagaaactccgccggcaccgaaatcgttacatttcttgatgatatggctgacctcttctcttctgaaaagtctctgaagctttctctctgtaggtgcattacccttttgtacctctgctccgcatactgatgtagactttgtattgtgtgcctttgatgaacctgtagcaccaccgattccgtcacgtcctgtgcgtcctccgagtagaatgattttatctcccggatctgagttaagtctctggacagcacgtcttggagccgcacccataactgcaccgatctccatacgctttgcaacataatttggatggtaaacctccttgacatagcctgttgcaagtccgatctggtttccatatgagctgtatccgtgagctgcttctctgacaagcttcttctgtggaagttttccttcaattgtctgtgaaaccggtactgtaggatctgctgcacctgttacacgcattgcctgatatacatatgtacgtcctgagagaggatctcggattgctccgccaaggcatgtagcagcaccaccaaaaggctcaatctctgtaggatggttgtgtgtctcgttcttgaagtttacaagccactcctctgtctttccgtccacctcaacaggtaccacgatagagcatgcgttgatctcatcagactcttcctgatcatcaagcttgccctctgcctttaatctcttcatggcaagaagtgcaagatccatcaggcagacaaatttgtcatttctgtccttgtaaatatttgaaaatgtattgagataatccttgtaggtattttcaatcggtgtgcggtagaagccatcgtcaaacttgacattcttaagctctgtagagaatgttgtatgacggcagtgatctgaccagtatgtatcgagcacacggatttctgtcattgaaggatcacgcttttcctcattcttaaaataattctggatatgaagaaaatccttaaatgtcatggcaaggttcaatgataaataaagctccttcagcttgtcctctgccatatccttgaagccgtcaaatatgatgacatcagcaggatcatcaaactcctgcacaagtgtctcaggcttttccatgccgatggcacgcgaatcaacagggttgatgcagtgcttcttaatagcagcaaactgctcatctgtgatagcaccctcaatcacatatgtgatagcacttctgataatcggctcctcattctcattgagaagcttcacacactgctcggctgaatctgctctctggtcaaactgtcccggtaaaaactctacagtaaatacttttgcatcgccatagtcaaatgtctcctcatagatatcatcaacaggcggctctgagaaaactgtatacagggctttcttgtatgtctcctctgatatattttccacatcatatctgattaatacacgtactgcctccacagttgtgattcccagataatgcttaatctcatgctttaattcctttgcctttaccgcaaagtcaggttttttctctacatatacacgacgtacgttactcatatgttctcctttcaattcgagagtatgtaaccaattattcgttaccgtccggctttttgcacaatcggactttaaaactatggttgtagtataacactttagttatgataagtataattaatatatttaatttgttttataagttgcgttaattatagttttcttatataatgatataagggtcaaaaggtattttgcccctcattgataaaaacagatgcaaataaccatatttatacggaggataacaaaatggatataaattatgagctttacaaggtcttttactacgtggcaacgtccctaagcttctctgaagccagcaagaagctgtttatttcacagtccgcggtaagccagtctattaagactctcgaaaagaagctgggacagactcttttcatcagaagcacaaagaaggtacagctcaccgcagccggtgcactgcttttaaagcacattgagcctgccatgaatcttattgcccgcggtgaaagccagcttttagactcaggcacacttggacttggccagcttcacatcggcgcaagcgataccatatgccgttatctgctggttccttacttaaagcagttccatcagaggttcccgaatgtgcctatcaaggtcacaaatgccacatctatccagtgtgtggagcttttggagcaaaggaaggttgacctgattgtcacgaattttccaaactcgcacctcaatcactcatacagacagaaaaccatatgcaacttttccgatgtttttgtggcaaatcccaattatttcaagcttcgcaagcaggagatagctttttccgagctcaataaatatcctatcatgatgcttgaccgaaacagcaccaccagtgaattcctgcataatctgtttttacagcaccagcttgacctgattccggaaattgagctaagcagtaacgatcttctcatagacctggccaaaatcggactgggtatcgcattcgtgcctgactactgcatcaaccatgagaataaggagcttttcgtgctgaagacaaaagaaaagatgcctccacgccagattgttgtgtccgtaaacactacaatgcccgtgtcagcatccactgaggaatttttaaatctgctcccagaagtcggcaactagttttccgacatttgctatattgcatggctttctgtcactccactcgcgtggatagagtaaatcatattctctctgccagaatctctcatctaatagcaaaatgacacctgtgtcctccgtcgtcctgattactcttccggccgcctggaggactttatttatgcccggatacctgaaagcatagtcaaagccacagtcgttttcggcatcgtaataatcctttaatatagttctctcattgctgatctgcggaagtcccgttccgacaacaatagcacctatcagtctgtcatttttcaaatcaatgccctcaccgaatatgcctcccatgattccaaatgccacaagtgttctgtccgattcctcactaaacctgtccagaaattcctccctctcagcctctgacatattatttttctgcagcataagctctgtttcgtctgcatatttttcacggtaaatatctgccacatcattcatcatcttatatgacggaaagaaaaccatatagtttccagtcttttgcgtgacaacagcattaatataccctgcaatccgctcatactcactccttgagcgcctcgtgtacctcgtgctcacatcggttgccatcgcaagcagtctctttttgctgtcaaacgtgctgtcagcatatatggcatagttgtctttttttgtgcttaacaggctcttgtaatagtttacaggcaaaaacgtcgccgaaaaaaacacagccgacttgcccttatccagcctcttttgtatattaagcgacgggtccacacaaaaaagctttagcatgaacctgccatcagcctcaagctcggaatacatcacgtagtgctcatccaccagatcatagatgttcaggaaattccgaagctcaaaataaaaatccataacatcccttttccccggaaactcattagccttctgcaaaaactcatccagaagtgtcataagcctcataaaggaaaataccatattaccaaacgtatcatataccgtgtaattctcacactcacgcttcatcccaagcagtatcttattgcacttttcaagcgctttctcaatggaacggctgtgctccttcataatgcgcttcacagtaaggaaatcctccttataaatctgagcgctatacatctgcctgcttctttcgaccatattgtgagcctcatcaatgagaaaaatataatctccctttatcccttcctgaaaaaatctcttaagataaacattcgggtcaaacacatagttgtaatcgcagatgacattatcacaccagctagccgtatcaagacaaagctcaaacggacaaacggtatacctatccgcctgtgataaaatatcatccctctcaatcatttcacatctgtgaagcaggtcaaaaaccgcatcatttactctgtcaaaatgcccctttgcatacggacaggttactggattgcattccatctcatcacacggacatagcttttcctttgccgttatctgaatagtttttgccctgtaaccatttttttcaagcagcgcaaacgtttcctttgcgactgttgcggtgattgtcttcgctgtcaggtaaaagattctgtctgccagctcctcaccaaccgccttcactgccggaaaaatagtagagatagtctttcccacaccggtcggagcctgcataaaaagaagcttctgacgcataattgtcctgtagacatccgaaacaagctttttctgccccggtctgtactcatatggaaaatcgagttctttgattgaagcctgtctttgatttttcatttcacactgaaacgttgcccatttgccatactcttccatcaggtcatcaaaccatttttttatctcttcaaatgagaactcctcgcgaaaatacttagtctgctccgtttccagattgcagtaggtcatctgaatgcctatcgtttccatattattttgcagagcaaaaatatatgcatagcacatagcctgcgcacggtgcacaaaaaccggcttttcaaacagctcaacccttctgtacattcccttaatctcatcaacaaaacacttgccatcctccgtaaagatgccatctgccctgccctcgacagtcagctcatacaaatcaccttcaacaacaagtgaaagcggcacctctgcctgatactccttccccatgctgccctggattttcctgtgaatgcgtgttccctccatcatggcatctgcactcatagctctggatgaccggttgtctatgtcaccctccctgaaaataaattccacaaggtttctgaccgaaatatgtaattgtgttttcttttcactatagttatttccagcttctgtcatgtactctccctgcatattccagattatgtcaacggttttgtgttccggcaatattttcagtctgactccagacatttttaatacactgaacataaagaagggagagctccaagaagaaactctcccaaaggatcttattcaattgtattacgctacagtgaatttatcaaccacattatcaaatgcctggtcatcgcccatatagcagaccttaaagtcattgtttgtaccaattccaatcactccaagaagtgatttcgcatcaataagaatctgtctatatttgagatcaatgtcaaaatcgcacttagaagcagccccaacaaattcctgaacatcatccaatgtgttaagtctgattactgtttccttattgtacatagttaacaccacctttataatctaaaacatagtgctttcgcacatgccaatcaattgttgcgcctattataacatctgatattcatttgtcaaaaaaatcataatccgtcattttccgtcaattcatgtcatttattttaataaataacttttgcgtaaccgatttttcactatattttcatgcatgttttttcaaaaaaacaatataactgtgaaattcttataaaaatggcatgatatttaattaatttaagttcattttttacaatttttcatttataaaactttattctcgtaattctttaacgcatctatatatatttcaccgagcttgctaagcttcgtgcccttgtgcttgatatagcctatatgcattttttcactttccttaagtggaattgccgcatagtcatcaccgtttaaatcctcagaaataatacctgagcacagtgtaaatccgttgagccccaccatgagattgagcattgtggctctgtcatcagcctttatgacacgcttgtactcatacgtgctcatcatctcctcagcataataaaaggaattgttcacgccctgttcaaaggtcagacatgggtactcctgcaaatcatcaagtgtaatctctttttggccggcaagcggatgttttttccagagatacacatatgtattgcatgtgaagagctctttaaactcgatgtcacattccttaaaaagctttcttaaaaccttttcattgaaatcacttaaataaagaactccaatctcactctttaagttctttacgttgtctattacctctttcgtctttgtctcgtgaacagcaaactcgtactcatccatgcccacctctttagcaagctgtacaaaggcctttactgcaaatgaatagtgctgcatggaaaccgagaatttctttttggactccacattcagatacctgttctcaagcagatgatactgctccacaacctgtttggcgtatcctaaaaactcctcgccctccgctgtgactgtaattccacggttatttctcatgaataccgtgattccaagctcttcctccacctctcgtactgtggcggacagatttggctgtgaaacaaaaagcttctttgccgcctcattcatggaattggattctgcaattgtaagtacctgtctgagttgttgaagtgtcattttctctcctattgtgaactgacggtttttagcagaatgtgtaactattcagcgcccgggcaccttcgtaaaaaccgcacaattgtaatatattagataaaattgtgtataaacgatgccctgtgtatcggtgatggtcctatctcctttagtgccttgatatgctctgccgagccatagcccttgtttgatgcaaatccatagccgggatatatgttatcatactcaaccatcatccgatcccttgtgaccttagccacaatactggccgcccctattgatatgcttttggcatctccctttataatcggaacctgctttatatccacccccgggattgtgactgcatcgttaagtgtcaaatccggtgccggatcaagctttccgattgcctgtctcatcgcctcatatgtagcctgcaatatatttatctcatctatccgctcgtgcgatgccatacctattcctacagaaaccgccttttccattatgacatcgtaaagctcatcgcgctttgcagccgtaagcttctttgaatcattgatatataaaatatcacagtcctttggcagaataaccgcacatgccacaaccggacctgcaagcggtccgcgtcccacctcgtctatgccgcaaatatgagcatatgatgcgtactcacgctcatatttcttgagaccttctgtgcggataagctccttctcatacttgtccagacgcttttttgcactatctacaagcttaatcactccgcccctttcatctgagctgtatgcctcaatgaactgtgtaagctgtgaatctttggtgtttttcagttgttccttaatatcgcctattttttctgctgacatatccttgtcctatcgtctattcttcgtaactattcttctatatctccggtctctccaaagtgatatgacctaatttaccacttctgaaatcatctatgatgagtgcagccgccttgctgtaatcaggctcccctccctttgaaaggcattttctgttgacagcgacagctcttataagctctatgatatcattttcctcgctcacctcgtatctttgtgccaaaagccccggatactctgcttttaggaactttacaagttccacggcaagctcatcaacatttaaaatctcatcctttatcgaaccgatgagcgcaagtctaagtcccactgtctgatcctcaaatttcggccacagtatgcccggggtatcgagcagctcaacacttttattgagcctgatccactgcttgccctttgtcacgcccggcttgtttcctgtcttggcacaggcttttccagcgtatgagttgataaatgtggactttccgacgtttggaataccaaccaccatagctcttaccggtctgtttttgataccacgctttcggtctctttcaatcttttccttgcaggcctccatcacgatatctgtgatgctcttcatgcctgacttgcttctagcatcaagactgactacaaaaaagcccttttccttgaaaaatgcactccactccctggtgcgctccttgtcggccagatccgccttgttcatcagaatgagcctgtatttgttttttccaagctcatcaatgtccggattacggctggatagtggaattcttgcatccacaagctctataaccagatctattaatttaatgtcctcctgcatctgacgctttgccttggtcatatgcccagggtaccactgaaaattcataattcacctgtcctttatctatatatgttataactattgctacttgattgttccaaagcttccaatgcctgaaaatctaaaccatgccttgccgataatatagtctctctttacattgccaatattggcatagcggctgtcctcactgttgtttcgattgtctccaagtacaaaatactcgtccttttctagctctataggatctgaggcaagccctgcatcctccattgaggcaacgtccgttgattccttgtacagctcatcattcacgtacagtgcgccgtcttttatctgaacagtatctcccggcaccgctaccactctcctgacataataatgcgacttattatttccgtttggcagaaatactatcacgtctcctgactttggctttgacatgatatatgcaaacctgttcacaagaatattatcatcgttctccaatgtctgctccatagcctggcccaccacatttgtacgtataccgaaaaatgacaccagcacatatgccagacctatcactacaatcagctccactacccacgaaacaatttccttgaacaatggcagattaaattttcttctttgccttctaaagctaagtcctgctcgtcttctggacatcttacacctcttgctaactaatattttattgcgtaatcttaattatatattgttttcatgtttgttgcaagctgtaaccctgaaaactaaaaagaccattctcatacgattgctcgcagaaaatggtctctttcgcgtaaaatattattttacaagctctttaaccttagcagcttttccgatacggtctcttaagtagtaaagcttagcacgacgtactttacctttacgtacaatctcaaccttctctacgtttggtgagtggagtggccatgtcttctcaacacctacaccgttagaaagctttctaactgtgaatgttgtacggtttgatccgttctgctttttgattactgttccctcgaatacctggatacgctcacggttaccctctttgatttttccgtatacctttacagtatctcctacagaaaactcaggtacctcggcctttaactgctcgttctcgatgctcttaataatttcacttgcgttcattttgtgacctcctaattattttgacgttcttaatgctactactattttcacaacagaggaccatctcttttattcacaacattggtactttaccacagattcatgggatttgcaagtattttttactatcttttgcctaccttatgcattatttttagtcatccagtatacggatgattttgaaaaatgcaatcccatactctcctgcagcctcatagacgcctcattgcctgcaattatctgtccatatggtatccatccgttttccagagccctgttgaaggcatatgtttcaagggctgtggcaagcttttgatgcctgtactgcggctttacatagagcatgccgatgctgccctcctcatggattccgataattcccgcgagggtattaatggtatcattagcagtattatcaccaaaaaaagcgccatatactgcccctgcctctattctttctatgatatagtccggattgtcaaagcccgggtacattggcgcagcctcctgtatatcatctgcatccagctttcttataattaagccatttggcatcggctttccatccggtctgtacaatccgctgacagatagcttttctttgtttgtatacacagcctgcctgcactctacagtctcattaaagccatttgctttaagaagttcaacatatctttgctgatgaagcactatgccgtttgtgatctgatctgtaacgttttctggaatatgctgactgctgtatttatcaacaggctttgtggcatcttccttcaccaaatcaataagcttcgactcgccctcatccggtcttgtatgaaagcatacctttgagaccatgtcccgaagcagatattcgccatctgcctcaaacagtatctcggcgcagcccctgtttataagctctatcatatcaatatgaagcagtttatttttcataagaaactctctgcatttatcaagtcttttaaacccggcatacaaatccggtctgcgctccttcgtgcgctcaatggacttttcaaggcgccatgcatctatctttttctgattgcctgacatgagtacctcaggcacctttttgtcatgccactcaacaggacgtgagtactgagggtattcgagcagattgccatgaaatgactctgtctctgccgaaatatcattgtgtaatacccccggaaccagacgtgaaattgcatctatcatcaccatcgacggcagctctccgcccgttagaacatagtcaccgatagaaacataatccgttaccgtctcctccagcacgcgctcgtcaataccttcatagtgtccacatagaaaaatgaggtcatcacactttgcaaattctgctgccatctgctggttgaacacgcggccctgtggagtaacataaatcagacgcgcattgtgattttttatttcttctgctgtatttttatatgatgtattttcatataatatattttcatcggcgatatttttctctgaattatcacctgagtggacctgattacatttattgatctgactcaccacactgctcacagcctgatacaccggctctgcctgcataagcatccccgcaccgccaccatatgtgtaatcatcaaccttattgtgcttattgtgcgcaaaatccctgatatttaccgtattgagtgatataatattctgttttaaagctctgcctgtgatactctctgacagtccctgttctatcatctgcgggaataaggtcagcacatgaaatctcatttcctatatctcctatatcatcctgttttacagttttacaatttaaaatgtatggttttgttcaattttatatcttattttacggtttttgcagtttgagatgcagctatctcaaacctgccagcagatgcaccttcatcgtgccattttccacatcaacgtccagtatacaatcctttattgccggaatcagcagatcatttgcaccggctttcttaacaacgtacacatcgttggcaccggtctggagtacatcagctatgactccaagctcctctccctcgtctgatgtgactgaaagcccgataagatcagctataaagtactcgttttcctcaagcggcaccgcattttcccttgtcacaaaaagaggtgcctttttatatttttctacatcatttatgtcatctatgcccttaaatttcaagataacctggttcttgaaaaatttgacagaagttatttccaaatccctgcgctctttgccattatccagaatgacatttttaagctttttaaaacgggcagcatcgtcagtggttgggaacacctttacctcaccgcgaatgccgtgtgtgctcgtaattacacctacctgtagtaaatcttccattctctgtctcctgatattaatataaatcataactattcagcccacgcacattctaaaaaccatacaataccggttctgaatagttactataaattataaaaaaacaggcatctcataagagatgccttcatgttactgtactatctcaacaataacctttttgtcttctttagaggctgcggccttaacaactgaacgaatagccttagcaatacgtccctgcttgccgatcactttgcccatgtcagactgtgcaacacgtaattccaaaacaattgctttctcgttttcggtctcagttacattaacctcatccggataatcaactaaagattttgcaattacttcaactaattctttcattacgccacctctttatcctatttctcgataccagcactcttgaagattctagctactgtctcagttggctgtgcgccgtttgataaccatttcttagctaattcctcatttacatgatactcgctaggatccttagttggatcgtatgttccgatctcctcgatgcatcttccatctcttggtgatctagagtctgcaactacgattctatagaaaggagctttcttctgtcccattcttcttaatctgatctttactgccattttgtttcacctcctcataggtttattgaataatatatatcaaaagtaaaataaatacttttgttaacaaaacatgaaattctttaatgaaattcctttaatgaaatccattaaaacggaagtcctttgaataagcctccaagaccaccgcctccacggcgtcccttctttccgcccatcatacctggcatctgcttcatgaacttctttgtctgctcaaactgctttacaagtctgttgacctctgatacatccacacctgctcctcttgctatacgagccttgcggcttggattaagaagctttggatttcgtctttcctcaggtgtcatggaatagatgattgcctctgtgcgggccatgcccttttcagcttcatctgtatcaatatccggcatcttgcctccaccgatacccatgcccggcatcatgcccatcacgcttgaaagaccgcccatcttcttcatctgactcatcgaatcaaggtacatctcaaaatcaaactcatttttgcgcatcttctgctcaagcttcttggcctgttcctcatcaatgttctcctgcgccttctcaatcatggaaagcacatcgcccatgccgaggattcttgaagccatacgctccggatagaactgctcaaggtctgaaagcttctcgcccatacctgcgtatagtatcggctttcctgtaacggctctgattgaaagtgccgctccacctctggtgtcaccatcaagctttgtgatgacaactccgtcaattcctatcttttcatcaaaggtacctgctacatttaccgcatcctgacctgtcatggcatctaccacgaggatggtctggaaaacatcagtagcttcttttatctcaataagctctgccatcatatcctcatcaatatgaagacgtccggcagtatcgatgataacaacattgaaatcgtttttcttagcgtgctccacagcagcctttgcgatgtcggcaggcttgtttttgtcacccattgagaaaacctcaacgccctgcttctcaccatttatctttaactgctcaatcgcagccggacgatatacatcacaggctacaagcagtgatttcttgcccttgctcttaagctttccggcaatttttgctgtggtggttgtcttaccggctccctgaagacctaccatcatgataacggtaagctccttgcccggcctgaaagcaatctctgttgtctcagagcccataagcttaatcatctcttcgtttacgattttgatgaccatctggccgggatttagaccattcatgacatcctgtccgattgctctctcctgaacactctttgtgaactgcttaacaaccttgaagttaacatcggcctcaaggagtgccatcttaacctctttaagagcagcctttacatcatcctcagtaagctttcccttgctgcgaagattcttaaaaacgttctgcagtttttctgataaactgtcaaatgccatattacagctcctctagtatctgattcgaaatagcttcgatttcattcattaatagctcattatgtgatttcttaaaatcatttgtcagctcatgaatccttcgtatgtcactctttatggacatgaacttttcaacaagatgtagctttgcctcatagtcaagcagcttcttattgcacctcttaatcagatcggcaacaccctgacgggaaatcccctcctcggatgctatctcaccgagtgacaaatcattgaagacaaaatcctcatatacctgacgctgatgctcattcaaaagctcaccgtagaaatcatataaatatgcctgttcaagtttttcttccatatcaagtatcctctttttccctcgaacctatggtagaataacacatagtttgcctggtgtcaagtaaaaatacttgatacttttatttttatatcatagtgcgtacaattcttggcttatagcccttcttctcgagcgcagcaataatctgctccttgtgctctgtaccaaaacactcaagcgtgatgcgaagctcgacagccgcacttctgtttgtagtgacaaactggttatgctccaacttgattacatttccctgtacatcagcgagagtctgcgcaacctttgcaagctcgcccggtttgtcaggcagaagcactgaaacagtaaagatcctgtctctgaaaataaggccctgctgtacaactgatgacatggtgatgacatccatgttgcctccgcttaagatagaaaccaccctcttgtcctttacaccgagatgcttaagcgcagctacagtcagaagacctgagttttcgactatcatcttgtgattctcaaccatgtcaaggaaggccacgataagctcgtcatcctccactgtgataatatcatcaagatttttctttatgtatgggaaaatatttgagcccggtgtctttaccgctgttccgtctgcaatggtatttacgcttggtaaagtggtcaccttgccgttcttaaatgactcctgcatacaattagcgccggccggctccactccgataaccttaatctttgggtttaagagctttgcaagtgtggatacacctgttgccagcccgccgccgccgattggaacgaggatgtactcaacaagaggaagctccttgaatatctccatagcaatagttccctgtcctgttgcgacagctaaatcatcaaacggatggataaatgtgtagccctctttctctgcaagctcatatgccttggcacatgcctcatcatacacatctccgtaaagcactacctcagcgccgtagctctttgtacggtttaccttgataagaggtgtggtggtaggcatcacgatgacagccttgcagccatagcactttgcagcatacgcaacaccctgcgcatggtttcctgcagatgctgtgatgagtccctttgccctctcctcatctgtgagtgtgcttatcttgtagtacgcacctctgaccttgtaagctccggtaaactgcatattttcaggcttcaaatataccttattgcctgtctggtcacttaaaaaatcgctgtaaataagctttgtctcaagggtgacctccttgaccttctcacttgcttcttcaaatttatctaatgtcagcatatttgttctccctttcatttcttcggtataactattcatacccacccacacattattcgcaaaaatgcattgttctcagtggttctgaatagttatttttcattatattataccaaaaattccgtacagatatatataaactgatatatcagattattataaacaatataacttatacgctcaaagatattctcaaattattccgttttagtatcaaacaatgcattcacgaactcgtccgaatcaaatttctgcaaatcatcgatagtctcaccgactccgatatacttgaccggcactgaaagctccgactgtatcgctacagcgataccgccctttgccgtaccatccatcttagtaagcacgatgcccgaaatctttgccacatcagaaaactctctcgcctgaaccagtgcattctggcctgtggtcgcatcaagcacgacgagagtctctctgtacgcatccggatactcactctccaggattttattaatctttccgagctcattcatcagattctttttgttgtggagccttccggctgtatccacgagaagcacatctgcgtttctggccttagaagctgcaaccgcatcatatacaacagctcccgggtcagcaccctcggcaccgccaatcatatcaactccggcgcggtttgcccattccttcagctggtctcctgctgccgccctgaaggtatcggcccctgcaataactaccttcttgccctgttccttgagctttcctgcaagctttccgacagtggtagtctttcctactccgttgacaccgattacaagcacaacagatttttcattttcaaatctgtaggctgtctcctccaccttcatctgctccttgatactctcaatcaagagttccttgcactctgccggctccttgatgtgctgttccttcaccttcctctgcagatcctcgatgatactctctgtagctctcactccgaggtctcccatgatgagaatctcctcaagctcctcataaaaatcatcatctatatgcgaaaatccactgaaaagtgaatctatgcctgaaacgatgttatctctggtctttgtcagtcctgaaacgagcctcttaaaaaagcccggcttcttttctttttcttccatttcaactctccataaataaaattttactgtgtcagatcattctctataagatttactgaaacgagtgtggaaacacccttttcctgcatcgtaataccatatagcctgtccgcagccgccatcgtaccacgtctgtgtgtgataacaataaactgtgtgttctttgtaagcttgttcagataatttgcatagcgcgaaacgtttgagtcatcaagcgccgcctcaatctcatcaagcagacaaaacggtgatggcttaagtgcctgaatggcaaacaaaagtgcaatagcggtgagcgccttttctccaccggacatctgcatcatattctgaagcttctttccgggcggctgtgcgacgattcttatgccgcactccagtatatcctcatcctccacaagctccagggaaccatgtccaccaccaaaaagctgcttaaaggacttgtcaaactctctctgaatctcggcaaacttctctgtaaactgctttctcataccactgtcaagctcatcaatgatgccaaccagagtcttttcagcctcgataaggtcatcatgctgtccctttaagaactcataacgcgttgaaatctccctgtattcctcgatagcattgacatttacatcgccgaggcgtctgatttcgtcctttatgcctgcaatcagcttctttaatgaaggcagatcatcgtatgcatcatttctaagctctgaagccgcatgcggagtaagctcatactcatcccacatatagttggtctgtgtctctgaagcctccttaagcttctctctctggctgttcagtctgaaaagctccttatccaaatcagcctgtttctttgaaacttcctcctgctttgcaaaaaagcctctgtaattttcagacatcttttccttttttgtaaggctctccctaagctcctcgtcaagcttagaattgttgtcctttgatgccagaatggtctgtgtgattgcatcaatatcagcctgcttctttttaatatcatcctttgcagcagctgcaccttccacaagactttccttctgctcatcaaatttctctatctctgaattgatacgattgatattttctatagcaaactctgccgtctttgtaatattagcaagctcaagtgaaatggcagcggccttgtgtgaagcctcctgctcaagtactccctgcttttcaagtatctcactgtatgagctgttttccttctcaagctgcttttcacgctgctttgatgcctcaagctgcgctgcaatatccttcttgccctgatttatctcttcgagctgtttttcaatcccggcattttctgtgcgcagatcctcgtagacattcgcactctccttcttttgctggtctgccctgtcaacagaaatctgtgctgtattctgctcaatatacttctcctgcagcaaggtctttgtggctgctatatcctcctcgccaagcgcaatagcagtcgcaatatcatcctttctggatctaagctctttaagctttgtcttagtctgatcaactctcttttcaagctcctcaatctcacgatttctcgcaagcagattggatgaatttttaaacgcaccaccggacatagagcctcccggtgccagatactcgccctcgacagtcacgatatggagtgaatagtgatttttctttgcaagcgcaatggcattgtcaattgtgtccaccacaatcactctgccaagcaggtatgcaacaacctcatcaaacttcggatcacacttcaccagcttatttgcaatgccaagcacacccttttcgccgagtgccgcctcattttttgtatttctgtttgcgcgcacactagtaagaggtaaaaacgtagcccgtccaaaatgatttgccttcaaaaatccaatcatctttttggctgtagcctcatcctcagtgacgatattctggatattaccgcttaaggctgtctctatcgctatctcatagcgcttatccacctggataagatctgaaaccactccgagaagccccggatttttagccttctgctccataacacgcttgatgctgttaccatagccatcatagcgctcggcaatgtttttaagtgactcaagcctggaaacagacttatgatactctgtggaagcatcctccatcaggcgggcattctctctagacttatctctccactccctggcctttgccaaaagagccgactccttttcctttaaaccggctatctcttcattgacagcattaagcttcttattagcctcatccaatatatcatcaagccctgcttcccttgtctttctatctaaaagacgcttggtaagctctgcctttctgatattaatctgctcaagcatagtggcaaaacgctgctgccttgactggatactgcctcgctcctgaagcagggcgataagctcattcttgcccttttccagtccgtcattgcagcggttgacctctgcaagtacagcctcatgctcgtttaccgcaagaagctcgttctgcttcatctgctctatatcagcttccagtgcagcctttttgtcatcatactctttcctgcttttaagacgctgcgccttttccttttcgatagctaaaagacgcgactgcaaatgctcatccgtcatttcggccgtgtgaatctgctcctttaaaagctctatctgattctcaagcttctgtctggtggatgaagtgctcgtgatgctctcacgaagagactcgatacgctcatccatctgctgcatatcgttcccaagcctctcatactctgccttgatgctctcgtatgtggcgttggtctcctttagctcgtcatccgcaatagcgtatttctcatcagctgacttaagctcggtctcaatgcgcgctgattcaagcaaaaacatgttgacatcgtagttcttcagctcttctctctttttaagatatgtatgagccttctcggactgtctctgtaacggacctacctgtctctcaagctctgtcaggatatcattgacacgcacaaggttctctcgctcattatcgagcttcttttgtgctgtaagctttctctttttaaacttcacaatgccggcagcctcatcaaacagctctcgcctctcctccggctttccacttaaaatcctgtcaatctggccctgtccaatgatggaatagccctctttaccgataccggtatcatagaaaagctccgaaacctccttgagtctgcacggattgccattgattagatactcactctcccctgagcggtaaacacgtctggcaaccgtaacctcattgaaatcaatcgcaagcgaatggtctgaattgtcaagtgtgattgcgacatacgcgtatccaagcggcttcctgttctctgtacctgcaaaaataacatcctgcatgctggcaccacgaagctgctttgcgctctgctcaccgagcacccatctgaccgcatcggcgacattactctttccactgccgtttggccctacaatacctgtgatgccgttgtggaactcaaaaacaattttgttggcaaaggacttaaagccctgtacttccaaactctttaaatacattaaaaactcctattccctgtttctgtacaaaagaagtgcctgatatgcagcctgctgctccgccgccttctttgtatggccttctccctcgctgacacgctcgccgtccacaagcaccgcaactgtaaactgcttgtcatggtccggaccgctctcatcaataagttcataggaaagctgctcgtgtctgccctgtataagctcctgaaggatagtcttgctatcataaaagagctgcttattctcaatatcagtcatgataaacctaagcacaaactcctttgcattagtaaaaccaccatctaaataaattgctccaatcactgcctcaagtgcatcagaaagaatcgattttctctttctgccacctgtatgatcctcgcccctgccaagacgtaagtactttccaaggtcaagtggctttgtacaaagtgcaagagtcggctcacaaacaatgcttgcgcgcagcttggtaagctcaccctcaggcttttgcggataattgataaacaaaaattcacttgaaactatttccaaaacagcatcgcccaaaaactccagacgttcgttatcagaatgctttttcatgtgcttttcattggcatacgagctgtgtgtcagcgcctgctcaagcagatgtcggttcttgaacgtatagcctattttgctttgaaattcatttaaatctgccataatttctcctctatttctatatctatccattttacatgttccgtgagtataacgaaaagccctcataataaagggcttttcattagttaaacatactactgctcgcttacagcttttttaatctgctcaacagcatcgcctacagtgacgattttctctgcttcctcattaggaatctcgatatcgaactcttcctcgatacccatgataatctggaatacatccagagagtcagcgccaagatcatcaatgaatgttgactccatagtaacctcggtctcgtccacgttaagtacctcgacaataatgtctctaagcttctcaaattccatttttaatacctctcatttctgtttatagtgaccaatcatacagcagtactgctatctaatcagccggcttattaataatatattctttaattttatcattaatctctttttccttaaatgtaacacattggaaaacagagttagtgatttcctttgccttggagctgccgtgggtctttaccacaagaccattcaatcctaaaagcggtgctccgccgtactcggtcgcatcaaatgactttagcgtattcttaagagccggaagtgcaagtgcagctcctatcttgctctttagtgtgctcatgagccccttcttgataaccccgataagagtggagctgagaccctcgtagagctttaatatgacattgcccgtgaaagcctcgcagactataacatcggcatctccctttggaatatcccttgcctcaatgcttccgacaaaattgatatctgtgcactctcgaagaagcggcatggtctcctttaccagggcattacctttctcttcctctgcaccaatattgaccagtgcaacctttggattcttcacgccgacaacatgctccatatagatagagcccatcttggcaaactgtactagatgctcagctctggcatccacattggctccacagtctatgagcagagatacgcccctctcagtcggaataagcggtgccaaaggcggcctttgtatgccctttatcctgccgactattacctgtcctccgacaagtacagcacctgagcttcctgccgaaacaaatgcatcagcctctttattcttgaccatattcatgccaacaacgattgatgactgcttctttcttctgattgccataaccggtggttctgccatctctataacctcaggcgcatctactatctctatctgctccttaggatatgtatacaaagaaagctccctctctaccggtaccttctgtcctacaagaaatatctttatatcatttcttttgttaaccgcatctaccgcaccctttactacctctgcgggtgcattgtcgccacccattgcatcgagtgcgacccttgttgtactttgcattgtgacctccctgtgcctgctaaaaagcaaactactaattgattaaataaaatatactataatcataggtataaatcaataaccaattcactactctatatggcttccatcattctcccggactcattgaaataaccttgccacagttccataaatcagcagtgcgctttgctgcatcaagtctgtcatcgtctgacttgaaatcaatatttactgagtggcatccgcactcaaggcatgtcacataatatgagctgccgcagtcctcctcgagaatcccggcaccgccacagagcggacactcatagatttcaactaaatcgtctatattattcatgataatttgcttccttctttctttaatatctaaatatcctctcagtataataacatccctgcaagctatatacaagcaaaaagtaccttcattttattatgggataaaaaagggatacaatcaatcaaaaaaggattgaacgatatcgttcaatccttaattttactggttttctactattagtcctgaggaatgatttcttttttgttgtaagatccgcagttcttgcaaactctgtgtggcatcataagctctccacatttgctgcattttactaaagtaagagcagacattttccagtttgctcttctcttatctcttcttcccttagaagatttattctttggacaaattgacatttgtttacacctccttaaacttgttaaatatatcctggaacgctgccattcttggatccggtacaaaactatcgcaactgcaggtgcctttattcaagttcatcccgcagactttacaaatacctttgcaatcgtctttgcacagaactctcattggccagttcaccagaatttcggcgtagacaagtttatctacatcgagttcaaacccaatcaggtagtcagtttcctccatctcttcatcgactaatgctccgtctgtgattttcagagtcttgtcaatgtcaaaatgcatgtttgttggaacttcttccaagcatcggctgcacggtatcgctatgtctatatctactgttcccgtgatgtgcactgctgcattctccacgtttgagatatgaagtgatatcggctgctttttcagaataggataatctcctagccgcgactcaaatgatgtgagcgtaagctctgtctcaattgttgtctctttattgatagattttacaatggttgatatatcaatcatagttctctcctattcacacctaaccaattatacatattggagtggtgtttgtcaacaaaattttataatttatccacaactttttgctttttattagccaacaagctttactgtctcgcggcagattgcaagctcctcgtttgtagggatgacgcatacctttacgcttgagtctgctgttgagataagtgcctccacgccgcgtgtcttgtcgtttgttacacggtcgatctttatgcccaggtaacctaaatatgccatgattttttctcttacaaagcttgtgttctcaccgattcctgctgtgaatgcgatagcatctactccgttcattgctgctgcatatgctccgatgtattttgctaccctatagctgaatacttctactgctgcaatagcacgctcgttgccctcattgtaggctgcctcaagatctctgaagtcgcttgatactcctgacatgccggctactcctgacttcttgttgagcacattcatcacaccatcgatgtcaaggttttctttctttgcaatgaactccatgattgatgggtcgatatcacctgaacgtgttcccattacgagtccctcaagtggtgtaagtcccattgatgtatctacgcatttaccgtttaatactgcgctgactgaagctccgtttccaaggtgtgctacgataatctttgagttgtttaagtccattccaaggtagcttgctgcctcctttgatacgaagctgtggcttgtgccgtggaagccgtatcttcttaccttgtacttctcatagtactcatatggaaggccgtagagatatgctttctcaggcattgtctgatggaaggctgtatcaaatactcctaccattggtacatttggcataagtgcctggcatgctctgattccgataatatttgcagggttgtgaagaggtgcgaggtcgttgcactcctctacctgtgctattacttcctctgtgatgactactgagtctgagaacttctctccaccgtgcactacacgatgtcctactgcatcgatctctgcaagtgattttactgcgcctgtctttggatttacaagtgcatcgagtaccatctggatggcctctttatgtgttggcataggtgcctctgtgatttccttatcaagaccctctttctgatatacgagtctgccatcgattccgattctctcgcagagtccttttgcaagtacctcctctgaatctgaattgatgagctggtatttcagtgatgaactaccgcaattaattactaatacattcattgttttgtctcctttggtttaaaattacaatactattgttagtataaacttatttttcaaatgcgacaagggtgtttttgtggtattatggttttgaactctaaaaaaaacattattgattaaaggagcagcaaacatgaaggttgcaggtgtgattaccgaatacaatccattccacaatgggcacaaatatcagctagagcagattaaaaggcagacatctgctgattatatcgtcgtagtaatgagcggtgatttcgtgcaaagaggtgagcctgccatcattgacaaatacgagcgcacacgcatggctcttttgagcggtgccgacctggtgcttgaacttccatcggtctttgccactgcttctgccgagttttttgccggtggcggagtcagtgtactcaaaaacacaggtgtggtggacatgctgtgctatggtgtggagtctgtggaccatgagcttacaaagcttgttgctggcgtgcttaagaatccgccttctgagtattccgcctctcttgccaggctgattcagggcgggatgagctttcctgcggccaggagcagagcgctatgtgaatattttcgagatacctatgacagcgcttccgagaaattagatgctttcatagcttcacccaataatattctggccattgagtatgagaaggctttgatggactgtgatattacaggatttcctattcagcgcgtcggtgaaggatatcacagcactgattcgacaagtgagttttcttccgctacagctgtgcgcggggtgatttcgaccttaattgatatagacaaacacaacactattactaatatgcagcttgataattcatggatttccacaaagttcagtcagctaatgccatcagactgcgccgatattcttgtcaattgtattttaggcggtcatattgtgtttccggatgatatttctgaaatgctttactatcgcctgctgactgggaaggataaaggctttgcgcagtatgcagactgtacaaaggagctttctgcaaagatagttaaaaatatttataaatatgaaagttttacgcagttttgtaacttactgaagagtaaaaatctgacttatacgcgtatttcgagagtcctcacgcatattttacttggtattgagaatgatgattttaatatatgtatggataatccttatctgcgcatactcggtttcaaaaaatcatcaggagagcttatgcatctcctcaaaaaaagagcatcagcgcctattattacaaaagtcgctgatgctccgtacgagcttatttccaaggatatttttgccgctgatttgtatggcaggctgtgtcattcacagcaaaatgaatttacacatggggttgtaattatttaatctacagctccattataatttctcgcgccagactttcctctataggctttgcatacactcccggtgcaaactcaacagtggctcctatgcctttttggagcacgaagcgcagcttgccgtctctcacctttttatcggtgtagagtttctttacaagctcttccctgtctatatagtcaggtatacgtgttggaagaccggctctctcatagagctttatcacgcgctctgcctgctcctctgacatatagccaagccgtgctgacataagtgcctgtgcagccattccaatcgacagtgcctctccatgcagcagcttgtagtcgctgactgtctcaattgcccggcctactgtgtggcccagatttaaggtttcgcgaagtcccgcctctcgctcatccttcatgaccacattgtacttgatacggcagttattttctgcgatatactcacatgcaaatttcttgaatgaatatatatcatccagattttcctctataaattcaaacatatcctcgctgcctaagcatgcatgcttgatggtctctgccatgccgcttgccatctggcgctgtggcagtgtcttccaggcagctatgtctatatataccttttggggctgattgaacagacctatggtgttggtagcaagaggtgtatcaattgctgtcttgccacctaccgatgcatctgccgccgctagaagtgtggttgcaaagttgataaacggcactcctctgccgtaggttcctgcaataaagcctgataagtcggttaccacaccgccaccgactgcaataatacagcagtctcttctgtacccctttttaagcatggcatcctctatctttgcctttgtctcacgtgacttactcttttccccagccgggaaaacaaacaaatccactgagtatcccgcatgctttatcttctcacagattggaagagcataaggatcacgcacatttgtatctgtaatcactgcaaatttctttatcttgcccgcaagaccattttccaggtcagatacaagggtgtctgagaggttgtagcctatctcaatatcatatgtatcatctactacttttttgagttctacattgaatatgctcatctttttctcctgttatgctatatttttgtttctcttatgcgggaaactgctacagtatccccacagcctgctttgcaagcttatctgcctcttcgttgccctctactcctgagtgtccttttacctttacaaaagtaagctttattttatccttaaccgacatgatgtattcgtgataagctatggtgcctgccttgtttcgcttccaggcccctgtggcccacatctctatgcccatgtagtcatagtatatgaccagttccttaattccaagctctatagccttttttacggcagcctccgcgccctttatctctcctgctacgttgcgcattgtggccatctcggcatcattatctgacccctgcagcacgtatttttcatggtcagtcacaagaaagcctccatagccataggtgtgtgtaaccttgttaaaggagccgtcgacaaacgcatacgtactattttcgccggatgatttcattcccgtaatggttttctctccggcaataattttctctccgttaataaatttttctgcctcttctatcgtcttaaagcttttatacactgctccctgatatccgtcaaccattgctttgcaatcattccagttgaaatatatcccgggaacctttcccttttttactgcatagtattttgatgccatgctttatttctcctataacactcttgacaaaaattcctgtaatctctcactctttggtgcgccaaatacttcctcaggtgtgccctcctcagctatggtaccctcattgatgaacatcactctgttggccacttctctggcaaagcccatctcatgtgtcacgactaccattgtcatgcctgcctctgcaagctccttcattactgaaagcacctcacctaccatctcagggtcaagtgccgatgtaggctcatcaaacagtatgacatcaggattcatagcaagtgaacggataattgccactctctgcttctgtcctccggaaagctgcgccggatatgcatctgccttatcgaggagacctattctggtgagaagctcatctgccttctttgatgcctcatccttcgtcatcacaccaagcttcaccggtgcgagcatgatatttgcttttattgtcatgttggcaaacagattgaactgctggaaaaccatgccgattttctgtctggtcacattgatgtctgtcgacttgtctgtcaggtctgttccttcaaaaaggatttgtcctgatgtaggtgtctcgagcagattgagggagcgtaaaaatgtagactttccacagcctgacggtccgatgatggcaattacatcacctctgttcacctctgtgcttatgccctttaatacctcctgctctccaaaactcttgtgcaggtcttttacctctagtatcacgttattatctttcattgcttctcagtctcctctcaagtttgcttactccgtggcttaaaagcatcactataaccagataaataagggctacagcaataagcggtataaatgcctcgtatgtgttgcttcgtatgatatctccaccctttgtcagatccatcataccaatataaccactgattgatgtctcctttaggaggctgataaactcgttaagcagcgccggaagtatatttttgacagcctgcggtatgataacaagcttcatggtctgtctgtaattgagtcctaagcttcgtcctgcctcaaactgtcctatatctacagacatgattcctgaacgcacaatctctgccacatatgcagccgagttgaggccgaaagcaatgactgctacaagtatcttgttggtcacagatgcaagcactacatagtatataataagaagctgtatcatgacaggtgttcccctgatgatggtcaggtatgccttgcaaattccgtttaatatggcaagaccgccgtttctgtcatggctggttctgactatcgcaattaaaaatcccagcacaataccaagcattacggcaaatattgtgataactattgtattgccaagaccctttacgatatacatgtaacgattgtccttgacaaagttgtcatagagcttttcctttataccgattgaagaacccgactggctgtcttttacgataatctcctgctttgtggtgatatatgtatcggtaaaatcaacatttttctgtctgtcctctgtcactgtaaagcctgctgccccgacatccaccttgcctgatgatacagcggcaatgattgcgtcaaactgcatatcctctacctgcatatccatgccaagctcatcggctatggcctgcatgatatccatatcaattcctgtgaccttgttatcctcatagtactcatatggcgggaactctgcattggttcctaccttaagtgtaccgtttgacctgtcaatgtccttcttcacgtagggagtctttcccacctgatcttcagagccgatatagttgtcgatgatgctctgaactgttccatcctgctgcagcttttcaagcgcagtgtttaccttgtcgcgaagctctgtattaccctttttcaggcagaatgcatagtcctcgttggtaaactcctcgtccagtatcttaagtcctttgttttcttttacaaaggcaagtgccggctgctcatcaataaccacgcagtcaatcttgccgacctttaatgcctggactgcatcagcacccttgttgtatctctctaccttggtgcctgaaccgtcgttctcataatcagatacatagatatctcctgtggtaccgagctggacacctatttttgcgccctccagatcgtccacacaagcgacctttttgctgtcacttttgccgcatgcgcataagccaacaatgaatgtggccattaatgctgccataagcaaaatcataatcggttttttcttaatggatttcatattattcctcatttctgtataaatatttattcacaattatatcatattagtttataaaataaaagagcctgattttctcagactcttttataccaaatatttatgcatcatgctccatgttacttaacttcttcgcctggtcggctgcgatacaggcatcaattatttcctggatatctccgttaagaatcttgtcaagcttatagagtgtcagattgattctgtgatctgtcacacgtccctgtgggaagttgtaggtacgaatcttctcagcacggtctcctgtaccgatctggcttcgtctctcctctgcctctgcatcctgcttcttctgaagctccatgtcatagagctttgtacgaagaagtgcaaaagccttttccttgttctgtatctgtgacttctcagtctggctgtagatgacaatacctgttggataatgtgtcagtcggactgctgaatctgttgtgttgacacactgtccaccgtttccggaagcacgcattacgtcaattctgatatccttgtcatcaatcttgacatccacatcctctgcctcaggcattacagcaactgagcacgtagaggtctggatacgtccctgcgactctgtctcaggcactcgctgcacacggtgtactcccgactcatactttaggatagagtatgcacctgagccctttaccatgaactcgacagacttcataccgccgattcctgtctcatcggcatcaagtgtctccaccttccagcctctgttctctgcgtagtgcacatacatacggtagatttccgctgcaaaaagtgctgcttcctctccgcctgcaccggcacggatttcgacgattacgttcttgtcatcgttagggtcctttggtagaagaagtattttaagcttcttctcaagctcctccacctgctcctttgaatccttaagctcttcctttgcgagctctctcatctcttcatctgattcctcatccaaaatagccagtgaatcctcgatattctgcttgcactctttatatttcttatatgtctcaactataggagcaaggtcactctgctccttcataagctttttaaatctgtttgcatcatttgccacatccggctcgctgagcagattcatcagctcttcataatggtgtataagatcttctaacttatcaaacatgtttttcctccttgctgtcaaacactcccgatactaccctgtcatttcccgccaggtcctttatcacatgtacatcgctaaatccggcaaactgcatcatctctgacacctgtctgccctggtcacagcctatctcaaaaagcagcctgccctgtggctttagatttgccctgcaatcctttatgatgcgcctgtaaaataaaagtccatcctcagagccgtcaagagcctcatgcggctcaaataccgacacctccggcatcagatgcggtatctcgtcgcttcttatatatggtggattggatactatcacatcatacatctcatcgacatgctcaaacagatcgcttctctcaaaatcaacaaacacaccgttaagccttgcgttttcctttgccacattgagcgcctgctttgagatatcacaggctgcaccgtccacattagtcgtgttctttaagatgcttataattatgcagccgcttcctgtacacatatcaagcactctcatacccggctctatcaccttgagtgcctcctctacaagagtctctgtatcctgacgcggtatgagcacattgctgttcacacggaatttgagtcccataaactcctgctctccgactatgtactggagcggaatacgctcagcgcgcttactcagcaatgcctgatattcccttatctgctcctgcgacatttcctcatccatatgcacatagtaatatgtgtgatttatcctgcatgccatggctaaaagcagccatgcatcgttttttgcatcaactatctttgctttttgtaatatgctttccccaagtaaaattgcttctctatatgtcatatataccttctatctggcggtcaatgtgcacacacattgttttcctcctgccatttcttccagtcaaacacggcctcaaccgatgcgatgccaacctctatcatttcatcatccggctcctttgtggtcattcgctgcattaaaagcccagggacactaagcatgttgacaaccggattgtcatatctgcccgcaagtctgataaactcataagatacacctgcgattacaggaataagcacaagtcgtaacaataactgcagcggctttgaatccacacggataaacatgaaaaacaatatgcttatgagcattactataagcagaaagcttgtaccgcagcgcttgtgatgttttgagctttttctcacattttccaccgtaagaggcagtccgtgctctatgcagttgatgcatttatgctcagagccgtgatacataaatgtgcgcttaatatcaggggtcagcgatataattgctatataccccagaaatattgccagtctgataacgccctctatgaacgctatgagcatctgtgagcttatcacctttttaaaaaaccctgaaaggaaatacggcaatgcaaaaaacagcgcgagtgctatgacaattgacagtaccactgtacctccaagcatggcattttcctgtttcttttctttggcagccctttttttcttttcttccgctgtgagttcttcttcctttttctttgaagccaaggtaccttcatcatcctcgtcctcgaaaaatgacgctgaatacatcagtgtgctcatgcccagataaagcgaatcgacaaagctcaccacacctcttaaaataggaatctttctaactgcatcaagcgtctttgaattcttacgctttgacaccttgacatctatttcatggtcaggctttctcacggctactgcgtatgtgtccttgttctgcatcattacgccctccatgacagcctgaccgccaatacctgaatacttcataaaacctctctatattccaaaaaaggttgaggtatattgcaacctcaacctttcaagtaactatatgattctatttcataccatatttcttattgaactgctcaatacgtccacgagcctggttagctttctgctgacctgtgtagaatggatggcactttgagcaaatctctacgtggatctccggctttgtagatcctgtaacgaatgtgttaccacagttacatgtaacagttgcctgataataatctggatggattccttctctcatgattttcacctcttttatattcttatcgtatttctatagcttcactctttatacccgtatgcccgatccgcatatgatacttgctgcaagagcgacacgttgcgtccgtttacatcccgataaacagcttagttattgtagcacatgaatctgtcaattgcaagacatttttataaaattctgtttttctttacaagattaacaaattccttgttgctctttgtgtgtgcaaacatgttgagtacgttctcaacagcctcatcagagcgcatgccgttgaaggctttacgcatattatcgactgctgcctgctcatcatcatcaaggagcagatcctcacgccttgttcctgattttactatatctatagcagggaagattctcttctctgaaagctttctgtcgagcacaagctccatgtttcctgttcccttgaactcctcaaatactacatcatccatcttgcttccagtatcaacaagagctgttgcaagtattgtcagactgccgccgtttctcatattacgtgctgctccgaaaaatctctttggcatatgaagcgctacaggatcaagtcctcctgaaagtgtacggcctgatggtggaactgtcacattgtaagctcttgcaagccttgttatgctgtcaaggagtatcatgacatccttaccatgctctacaaggcgctttgctctctctattaccatctctgacactctcttgtgatgctcaggaagttcatcaaatgtagagtagattacctcgacattgtccccctctatagcctccttgatgtctgtaacctcctccggtctctcatcaataaggagaataataagatgcatctcaggattgtttacagtgacagactttgcaacctctttaagtaatgtggtctttccggccttaggctgtgaaacgatcatgcctcgctgtccctttcctattggagagatgagatctacaaccctcatcgcaacacttgctccgggtctctcgagacgcagtctctcattcgggaatataggcacaagatcctcaaagcttgtacgcttctgtgctacatccggtgtatatccgttgacagtggtcagatataaaagagcctggaatttctcacgctcagacttcaccttcatattaccctttacgatatcacctgtctttaaattgaagcggcgtatctgcgcaggtgccacatagatatcatgatctcccggcatataattatcacagcggataaatccaaagccctccggcattacctcaagtatgccttctgcctcttctccactgtcgagtgctgcataatcatctttaaaagagttggcgcgctcctcggctgtaccgtttttctcagcctcctcagcctcttttgcatcctcctcgagcattctttcaataatctgtccctttttcagtgatgaaacgcccttaattcctcttgccttcgccagatccttaagcacaaatgccgacaaactttcatatttttctctcatctgttccatttcgtcttctccttaaatttgataacagtatttattcaattcgtctaaacaatattatttaacaaatatatctgtgtagctattgggaaataacgcctgaattgacttttgaattattaattattgattatacatcatttctttaaaaatataaagcgatttcttattttttatcatatttttatataatcggttatctgcatagttacttgatttaaatcacctgcaatgttatgattattcaaaagaatttttagagggagaattaccatggataataaagaaaaggcactgaaatgccacgaagagtggaatggaaaacttgaaaccatcgccaaatcaaaggttaattcgagagaggatcttgcaattgcatacaccccaggtgttgctgagccatgtaaggtcatagccgaggataaggaggctgcatacaaatacacctggaaggcaaatactgttgccgtagtgtcagacggaagtgctgtgcttggtcttggaaacatcggtccttacgctgccatgcctgtcatggagggtaaatgcgtacttttcaaggagtttggaaacgtaaacgctgttcctatctgtctcgacactcaggacactgaggagattattgctgcagtcaaaaatatcgcaccgggctttggcggaataaacttagaggatatttctgctccgcgctgctttgagattgaggagagacttaaagagatgctcgatattcctgtattccacgatgaccagcacggaactgcaatcgttgtactcgccggtatcatcaactctctgcgcctgaccggtaaaaagaaagaggactgcaaggttgttgtaaacggtgcaggctcagcaggtgttgccatcactaaacttcttctgacatacggctttacacatgtgaccatgtgtgaccgtctaggcatcataggaaaggactatccaaacctcaactggatgcagcagaaaatgacagaagttacaaaccttgaaaatgcaaagggtactctcgcagatgctttaaagggtgctgacatattcgtaggtgtttccgctccaaatatcgtcacagccgagatggtttcttctatgaacaaggactctatcctttttgccatggcaaatcctgttcctgagattatgcctgatgtggcaaaggctgcaggtgccagagtggtcggtaccggaagaagtgatttccctaaccagataaacaacgtggttgcattccccggaatcttcaagggtgccttagaaggacgcgctacacagatcactgaggaaatgaagcttgctgccgcagaagcactggccggtcttgtttctgacgaagaattaaatgatgattttattatgcctgaggcatttgaccctcgtgttgccgctgttgtcagcgaagctgtaaagtcacatatttaatatgagatactattcactcaacagatactgccgcgatacattcggtgaaaagctctacaagctctctctagatggaggcatgacctgtccaaaccgtgatggcacactctcatcgcttggatgcctgtactgcagcgccggtggctccggtgattttgcggcggaccgcagcctttccataaaggagcagctgtctgccgctaaggaaaaggttgcttcaaagagcagctgtgagcactttatcgcatattttcaggcttttaccaacacatatgcgccgatagattatctgcggcgcatattttatgaggctatagaagatccatctgtcgctgtgctgtccatcggcacaagaacagattgtttttctaccgaaatatatgatctgctctcagaattaaacaaaataaagcctgtctggatagagctgggccttcagaccattcaccggtctactcttgatgccatgaatacacatacatgtgttgaggatttcatcattgtaacggatgagcttagacgacgtggcataaaggttattgcacatctcatactcgggcttcctcatgagacacggggaatgatgcttgaatcagttgattttgttgctaaaagcggtattttcggagttaagcttcagctgctgcatgtactaaagggcacaccactggctgatatgtatattaaacagccatttgagctttttacgctggatgattactgcgattttgtggtagactgtatagaaagacttccaaaggatatggttatccaccgcatgaccggtgatggaccacgttctttacttgttgcacctctttggagcacagataaaaaacgggttctgaacacaatcaataaaagatttgaagtgcgagacacatatcagggacgattaaacttgttttaaaggagaaaatcatggctgagccatttaccatatataagctgacaattttatacatgctcgacaaagcgggctttccgctgtcaaacacacagatttccaatttctttttggaaaaagaatacaccgactacttccgtgtacaggaggtcatcggtgatttagtaaatgctgatttaattaatttcgagtctactcattccaatacacagtacactctgactgctgccggaaaagagactctcggtttcttcaaagacaagattaccgacggtattgagtccgatgtaaagagcttctttactgacaacaagctcgagttcaggcaggaaaactccattcttgccgactattacaggacaactgaccgcaaatatgcagtacgttgtcaggtgcgctcagagagcaccaccatcatcgacctgactctctcagtcggcacaaaggagcaggccgaggccatctgcagcaactggaagaatcagaacgaggatgtgtacgcatacctcatggatatgctgcttcgataaattattttttagtttttcttacagagtagccgaagcttccgagcttatctccaaagccaaaatactctccgtgcgagtacatcacgaggccggtatcattgatatgaaatttcccggtcccgtccatgtatttatcatccactgtcacgccgacaacatctgctataaacattgtatggctgccgagctcctcgatttttcttaccctgcactcaatatttaccgggctttgtgatattccgactgctgacacatgctgcatcgcaagcggtgtcagatgcagttctttaaatttgtccacatccctgccgcttttcactccgcagtagtcgcaggctctaagcagctcctcggtggtcagattaaccacaaactctccggtttctttaatcatgttataagaaaagcgctccggccttacagatattgaaagcataggcggattggtgcacaccgtccccgcccatgccactgttattatattgttatttccggccttgtcagtgacactcaccatcacagccggcaccgggtttagcatattgcccggcttccagttttgttttcccatatgttaatttatcctttaatttttctttaatatccttttatatccactaattttcctttaggttttccatgctttctttaagccttgcccggtttgcatcctcaagctccgtgagcggcagacgaagtcctcccacattatatcccaaaagcttcatagctgcctttacaggaatcggattcacctcacaaaacagtgactctattaaatcaaggtatttaagttggatatcaagtgctgatttaatatttccattcagaaattccatcaccatgtcatgcactgcagccggcattacattagacagcactgatatcacaccgattccaccgagtgagagtattgggatgatctggtcatcatttcctgaataaatatcgaggtcatttcctgccagcttctttagctttgcaacctgcgatatattgccacttgcttccttgattcctactatattttcaaaattcctgccaagccttgccgcagtctgcggaagtatattgcagcctgtgcgcgatggtacgttgtacataatgattggaagcccaaccgcccctgctatcgctgcatagtgcgcataaagaccattctgtgtggctttattgtagtaaggtgtgacaacaagcagaccgtctacaccaagcttttcaacctcctgtgaaaaatctatcacattttgtgtgcagttggcacctgttcccgctattacaggaatctgcccggctgtctcgtctaccacacattttattaccgaaagtttttcttcctctgtcattgtggcaggctcacctgtcgtgccacacacgataattgcatcagtgccaccgtctatctgccttctcaccagcgtcctaagcattccatagtttacactgttatcctcattgaaaggagtaattagcgctactccggcgcccttaaacagagacatatatacctcccaaatacactattttacttaactattttatactaaactatttaacctatactaaaatattaaagcctgatgtcaggattttcttttattatatcagcaattaattctctctcatccatgtgatgcttcacaccctttatctcctgataatcctcatgtccctttcctgcaagcactatgatatcaccatccttggcattctccatgcagtatctgatagcctccttacggtcaggaattgtcacatactctccatctgccttgtgtacaccctgtaaaatatcattgattatatccataggctcctcatctcttggattatcggatgtgacaacagtaaggtctgcaagtctcgatgacacctctcccatctcataacggcgtgactttgccctgtttccgccacaaccaaacaggcatacaagtctgcccggctcatactccttaagagtggtgagaaggctttcaagcgccatcgcattgtgtgcataatcaatcataagggtatatctctttgtaacaggaacaatctcgattctgccctttacactcacatgatgaagagcctccccgattgcctttttatccacattgaaatgatggcagatagcaatggctgttagtgaattgtatactgagaatttgcccggcacattgacctccacatcaaaatccagaagccctgatacatggtatttaatgccgagtgctccatgctcctttttaagctcaacattttctgctaccaggttgtttgtggacttgtagccgtaagtctccacctggcatgtgtgtccattcataataccctctaagtgctcatcatctccgttaaagataccaagcctgcactgtctgaataaaaggctcttgcaatgcatgtagtctgcaaaatccttgtgctcgtgctctccgatgtggtcaggctcaagatttgtaaatacaccaatatcaaaggtaaagcccgatactctgtgaagcatgagagcctgtgatgacacttccataacaactgcatcgaggccttcatccaccatctccttaaacagctcctgaactctgtatgactcaggggtggtatttgctgacggaattctcttgtcaccacatatagactctattgtaccgataagtcctgtctttatgccggctgactcaagaattgactttaccatatatgtggtagtggtcttaccctttgtacctgtaataccgatagtctttatcttctcggccggataatcaaaataagctgctgacatacacgcaagtgcaagccttgtatcatctaccttaatatatgtcaccccttcgataggagtcacatctttttcgacaaccactgccgctgcacctttctttaccacatcagggatgaaatcatgtgcatctgacacagctcccgatatgcacacaaataccgatgccttctccaccttgcgcgagtcatacacgagtgtggaaatctctatatctgtgcttcctgctaatactttataatccattctttcaagtagtttttcaagcttcattttattttctcccatattttattatatttttgatatatattttctgttaattttgtttcttaaagatttgtaactattcaaccacagacattcgccaaaccgcacaatacttgtgatttatatgatatcaatttctcctgagaagacctcagtagcaggtccagtcataaacacatgattggtctttggtatatactcgatagtcagatctccgcctcttagatgcacaagcaccttgttgtcagtctttttgttgagtatacatgccatgacggtcgcacaggttcctgtaccgcaggcccaggtctcagcgctgcccctctcccatactctcattttcgcctcattccttgaaagtatctctacaaactccgtgttggtgcgctttggaaacatcttatgattctcaaaaagcggaccgtatttctcaagctcaaaacctgccacatcatcgacaaacactaccgcatgaggatttcccattgaaacacaggtcatgtgccactctctattgcctgctgaaatcggttcatctattaccctgtagtcatcaccataagcacttccgtctgctttcacaaccggaatgtccccaggcgtcagaataggctcacccatatccacgcgcacctgtgataccttattttcctcaacatatagtgtaaggtacttgatgcctgctcctgtctcaaccgatatttcagtcttgtcagtaagtttgtggtcatacacgtatttcgccacgcagcgtatgccgtttccgcacatctcggcttccgaaccgtctgcattatatatcctcattctaaaatctgccttatcagacggacctattgtgattagtccgtctgagcctattccaaaatgcctgtcactgacatatattgacacccttgccgggtcatccaacttctcctcaaaaagatttacatatacataatcatttccacagccgtgcatttttgtaaatttcatagtgatcacctcgttattggttttatattggtaactatattatacagcgcactttcttgtttttctatagcattttgtgcgttttatgttgcgttttgtgctgttatagattatgcttatagtaacatcttattatcaaaggagcatatcatggattcaaattatacaaaagcaggctacctgacggagccttttaaaatatttcatctaagagatgaacacaagctaaatatagatttccattaccatgatttccacaaaattctgattcatctgcacggcaatgtatcctactgcatagagggccgcagctatgagctcaaagaacatgatatcgtgcttgtcaatgccggcgaggttcataagccaatattaaatgacgattcaatttatgaaagaatcattatatatgtgtcacagcagcttattgacgattatgtgagcaaaggctatgatctggcatgctgtttcaagcaggcctatgctaaccagtcacatgtactaagactcgctgcggccaagggcagccgcctggctgatacaatcaagggactagactctacacttagagaaaccaatgaatacgcaaatgagctgtaccagaagctcctgtttttagagtttctgatacagctcaatcgtatcaccctgcatggcggtatcgaatatattaacacattttcctcaaacaaaaaaattgtagagattttgaatttcttaaataagaatttaacaaaccgtataagtattgatgaactggcagataaattctatatgagcaggtatcacctgatgcacaccttcaaggaagaaaccggatgcaccataggttcatatatcacaacaaagcgtctgctgctcgcccgcgatatgattcgcgacggaagcagtgtgtctgccgcatgcgatgcctgtggattcggaagctattcctcatttatccgcgcataccgcaagcaattccattctacccctacaaatacataaaagcttcacgatatatcacaggaagcttttaattatttttagtgctgcattatctctcattaattacatttataagctcaggtatgagctgcttcttacgcgacactactcccttaagcataattccatccttgctctgtggcagattgtatgctgaagccgctattgacgctgcctctgcaccactgtagatgagatatgtagactcattaagtatatccgtgagcataacaaagagcatatcaagctgtttttccacctgcatcttgtcaagcagaggcaccactctcgcctgtaccttatcgagctctgttctcgaaagagcagaaatctgtgatactccaaatgtataatcccctgaatgaaagattttaaaatcctgatttaatatttcctcttctgtcttgttagcaaagttactgcctgcctcgaacattttctgggcaaactcttctacatctatctgcgcaatctccgccaggataagtgctgtagatttgtcaacctgggtacatgtaggcgaacggaacactagtgtgtcagagagtattgcagcgcacataagccccgccatctgaggagtaacctccacacccttttccatatacatctgatagatgatggttccggtacatccaagcggctgatttctgaaatacacaggtcctattgtctcaagagaaccaattcgatgatgatcaattatctcaagaatctcagcctcatcaatgttggccactgcctgtgaggtctcattatgatccacaagtatcacctgttttttccttgcattcattaaatttctgcgtgaaaacatacccacataattttggttttcgtcaagtattgggaaatccctgtgtcggatttttgaaacagtatcacgcacatcatccacataatcatccaaatcaaaatgaataagattttcccttgtcataaatgactttatcggcatactctggtttatcagacgcgatgtggtaaacgtgtcatatggtgtacttatcactaccacgtccttagcgtttgcagcatttatgacatccttcgatatatcgaagccgcttgtcacaatgatacagctgcagtttgcctcaatacatataagctgtgactcttcacggtctgatatgatgaccagatcatcctcagccacatttccctttatggtatcaggtgtacctgctccaactataacctttcctttcacaaaatagccatgctcattgcctgcaactatcttgccatccagcgtctctataatatttctgtactgggtcctcgcctttgccaggatagaattgtcatacacatccatatatgactttgctatatcacctgtcacaataagcccttcaagcttgtccttcttattgacaaccggaagagtgactacgttgagtatcttcatcatctcccatgcctttttcatggatagattactgctgacaccctcagtccttctgatatgtatatcctttatctgtgtgccaacatcctttaaaagggcaggcgtatctgccttaaaataatccagcacaaatgctgtctctgcactgatgctgcctgctctcattggtatgtattccattgtatcgtctgtatgtgatttaaggtttgcatacgctattgctgcacagatagaatctgtgtcaggatttttatgtccaacaactcttacaatcttttttgccatttagtcttcctctctgtctgccttataaaatgtcaaaatatggtgcaactccctgactgggaactgcaccaccctattacaataatatttattaaaaaatcgaaccaaagaaccccaatatatacaatgcgattgcaacaaaaccaaatgtattgataatagccagcacagtagagatgactgcaaaagtctttgttgttcctacctgcttctcaagctctgacactgtgtccaccttgtctcccattaccttaaagagatcctgaatattcctgaagcacttaacattctctgtatgtaccttgtcagacagctccgcctttaacgaaacaagctgatcattaagctctgtaagcgactgaagcatatgggcattcgcctcatttaccgctgatgtaactgctgctgtgccctcctctgtgatacgccttgtctgctctaatgtgtcaccaaaatcaagactctgacctatattctggctgatgcctgatatctcagtgccaagtgactgtccgagatttccaatctgtccggacatcgaactaccaagattgtccatattggcatttaccgagcgtccaagattatccatatctgagcttacctgacggcctaagctgtccatgcctgcattcatagattgctctatctcagccatcttttcatgaacactttctataagcacatctatctgcttagcaacctgtgcagtgattccatcggctttttcctgtctctcgtcaagtatctgctgcagctcctctgccttagcttccctctcctcaactatggttgaaagctcctctgcttttgattctttcgtattaagcatctcctgaagacgttttgccttttcacgaaactcatcaatttgtgttaacaaaaaatcatctttatccatttgtatattatcctcttttttctgcactctttcactacggttaacatcgtctcttgctacacgggatgccattactgttcttgaaggtactgcccgttccgcttgttctgtagatataaatctttttgcacgtctatctaatatgcctgacattcgtattcctccgatggttcaattaaataccattaacatatatattgtaccattacatattgtatttgtaaacaaaaaaaccacgaaatatagtgtaaccacaggagaaaaagcaaaaatcccacagggcaaatgccctgtgggataaaatatataccgtgactaatgaattagtcctctccgtataatttaacgagtttctcaaggtgtgtataacgtgccttagctgtctcctcagacttagcaaagagtttctctgctctctctgggaatggcttgataagacgagtataacgtgcctcgttgttaaggaactcctggtaagatccgtcgccggcctttgatgtaagtgtgaatggattctttccttcagccttgagtgcagggttgaatgagaagaggttccagtatccagccttaacagccttcttcatctcatcctggcagtggttcataccacccttagcgataccgtgaagctcgcaaggtgcgtatccgatgatgagtgatggtcccggataagcctcagcctctgtgatagccttaacagcctgtgctgggtttgctccaagagcgatctgtgcaacgtatacatatccgtagctcatagcgatctctgaaagtgacttcttgcttgtctctttaccggctgctgcgaactgacatacctcaccgatgttagaagccttagaagcctgtccacctgtgttagagtacatctctgtatcgaataccattacgtttacgttctcaccagaagcaagtacatggtctaatccaccgaaaccgatatcatatgcccatccgtcaccaccgaagatccatacagatttctttccgaggtaatccttcttagcaagtacttctttagatttctcacatccggctgctgctgccttctctaactctgcaataagagctgttgttggctcaacatttgcctttgtgtcatcctttgtctcaaggaacttatctgctgctgccttgaactcagctgtagccttgtctgatgcagcgatctctttaacaagctcgatagcctggtcacggagatatctctgtccaacttccatacctaaaccatgctcagcattatcctcgaagagtgagttagaccaagctggtcccttcttagagttgatatttactgtgtatggtgatgtagctgccgggttaccccagatagaagaacatcctgttgcgttagagatgtacatctgctcaccgaagagctgtgtaataagtctagcataagatgtctcagcacatcctgcacatgagcctgagaactcaaggagtggctggttgaactgtgatcccttaggtgttgtatcaaccattccggcatctgtcttcttagaaacgttagctactaagtaatcaaatactggctgctctgctgcctgagactcctgtggctgcattgagatagctgctgtaggacaaactgtgatacactcaccacatcccatacagtcaagtggagatacgctcattgtatacttgtaagcgcctgcctttggcttcatatcagcaaccttcatgttgtcaggagctgcctttacttcgtcatctgtaagtaagaatggacgaattgtagcgtgagaacatacaaatgcacagttgttacactggatacacttctctggatcccactgtggaactgtaacggctgttcctctcttctcgtatgcagaagcacctgttacatactgtccgtctgccttgtcagcgaatgctgaaactggaaggctgtctccatccatcttagcgattggatcaagaagctcgttaacaagcttaacaacctctggacgtcctgtgcgctctgccttaggagcatctgcctctggattcttccaagactcaggaacctctaccttatgtacagcgtcaacaccggcatcgatagccttgtagttcatctctactactgcatcacccttctttgagtatgacttcttagcagcagccttcatgtactctacagccttatcgataggcattacgtcagcaagcttgaagaatgcagactggagaattgtgttagttctcttacccattccgatctcgatagccttgtcgatagcgttgattgtgtaaagctgaatgttgttgtcagcgatatatttcttagcgtcagcgttgaggtgatgagcaagctcttcatctgaccactggcagttgatcatgaatactccgcctggcttaacatcctgaaccatcttcatgccctggataacatatgcagggttgtggcatgctacgaagtctgcctggttgatgtagtatgggcttctgattgggttgtcaccaaatctcaagtgagaaattgtaacaccaccagtcttctttgaatcatactggaagtatgcctggatgtatttgtctgtgtggtcaccgatgatctttgtagagttcttgttagcacctacagtaccatctccgccgagaccccagaacttgcactcttttgtaccaggtgcagatgtgataggagctggcttaacctctggaagtgaaagatttgtaacatcatccacgattccaattgtaaatctgtgcttaggagcatccttctcaagctctgtatatacagcaaatactgaagaaggtggtgtatccttagatcctaatccgtaacgtccgcctactaatacaacatcgttcattcctgcttcacgaagtgttgtagcaacgtctaagtataatggctcaccaagtgatcctggctcttttgtacggtctaatacagcgatcttctttgctgtctttggaatagcattaagaagagcctctgaagaccatggacggtaaagacgtaccttaataagtccgactttctctccctttgctgttaagtaatcaattacttcctcagctacatcattgatagaacccatagcgatgattacacgatcagcgtcaggtgctccgtagtagttgaataatttgtaatctgtaccaagcttagcattaaccttgtccatgtacttctcaacaactgctggaagctcatcatagaacttgttacatgcctctctatgctggaagaagatatctccgttctcgtgtgatccacgagctgctggatgctctgggttaagagcgtgtgctctgaattctgcaactgcatccattggacacatctctttgagatcttcataatcccacttctcgatcttctgaatctcatgagaagtacggaatccatcgaagaagttgatgaatggaacctttccctcaagtgctgcacagtgtgcaaccggtgaaagatccataacctcctgtggatttgtctcacaaagcattgcgaaaccagtctgacgacaagcatatacatcactgtgatcaccgaagatattcagtgcatgtgaagatactgtacgagctgatacgtcaaatacgcaaggaagattctcacctgcgattttgtacatattagggatcataagtaaaagtccctgtgaagctgtaaatgttgtagtaagtgcaccagctgcaagagatccgtgaactgtaccagcggcacctgcctcagactccatctcaactacctttacagtgcttccgaaaatgttcttctgtcctgctgctgaccactgatcaactgtatcagccattgggctagaaggtgtgataggatagattccggcaacctctgtgtaggcatatgctacatgagcggcagcggtatttccatccatcgactgttttgctctagacatgatatttcctcctgtaaaataaatgttcaattatagacatgaatcagaatgtctctacataatagtttagtttgtgcgctgtaaaaaatcaagtttttttagcaatacattgtacaaaaaccctaaaatatttattaacaaggtaaaatttatgtacaaaagggcacaatggctataaatcgcctgtaaaacacttgcaaaatactggttttacgttaaaatagaaacgatgtgttacagaaacgaacaggttattaaataggaaaggattgaataaagacaaaatgattagtgcaaacaatattacattaagaattggtaaaaaagctttatttgaggatgtcaacataaaattcacagagggaaactgctacggacttattggtgcaaacggtgccggcaagtctacatttttaaagattctctcaggacagcttgagcctacaagcggtgatatcgcaatcactccgggacagagactgtcattcttacagcaggatcacttcaagtacgatgagtttacagtacttgatacggttatcatgggtaataagcgtctctatgatatcatgaaggagaaggaagccatctatatgaaggaggatttctcagacgaggacggaatccgtgccagcgagcttgaggctgagtttgccgatatggacggctggaatgctgagtcggatgcagctactctcttaaacggtctcggtgtacctactgaggatcactacactctgatggcagatctgccgggtgcagtaaaggtcaaggtgcttctcgctcaggcactgtttggaaatcctgacatactgcttctcgatgagcctaccaaccacttagacctcgatgccatctcatggcttgaggaattcctcatcaattttgagaatacggtcatcgttgtatcccatgacagatacttcctcaacaaggtctgcacgaacatcgccgacatggattacggtaagatccagctctacgcaggaaactatgatttctggtatgaatcaagccagcttattgtccgtcagatgaaggaagcaaacaaaaagaaagaggaaaaaatcaaggagctgcaggaatttatccagcgtttctctgcaaatgcctctaaatcaaagcaggctacatcaagaaagcgtgccctcgaaaaaatccagcttgatgaaatacgtccatcaagccgtaaatacccatacattgatttccgtcctgagcgtgaaatcggaaacgatgtgctctttgtcgagggtatttcaaaaaccatcgacggtgtaaaggtacttgacaatatctcattcactgtcaaccacgatgacaaaattgcatttgtcggaggaaacgagcttgcaaaaacaactatgtttaaaatccttgccggagagcttgagcctgacgagggctcatataaatggggtgtcacaaccagccagtcatactttccaaaggacaataccacaatctttgatactgatgagctaatcgtcgactggctcacacagtactcagaaatcaaggacgccacatatgtgcgaggtttccttggccgtatgctctttgccggcgaggatggagtaaagaaaatgcgtgtactctccggaggagaaaaggttcgtgtactgctctcccgcatgatgatcatgggaagcaatgtgctcatgtttgatgagcctacagaccacctcgacatggagtcaatcacagcattaaacaacggaatgataaaattccctggagtaatcctctttgcctgccgtgaccaccaggtagtccagacaactgccaaccgaatcatagaattcctgccaaacggttcaatgatcgacaagatcacaacctacgacgaatatcttgagagcgatgagatggcacgtaagcgtcaggtctactcaatgagcgaggacgatgaaaacgacaactaaacgctaattaattaaaaagaagcatcccaaaccgggatgcttcttttattaagccgtaaagtgaggtgggtgattccctgcctgtctttgactataaaaacatattataattatatccattgttataggcctgtgtataccttccattggcgccatatgtgttggtcttttctgcctcattctttgcggcatactcaagcattgaagccttgcttgccactgcgtaagcataagagccattccccttaaaaagtgcatcaaccttagtcgaatcagcctttttaaaggtatcctcgtcgacagacagcttgccggacttggaatcaactgtgattcccaccttcgcaagcgactttgaattgatatcagtaagtgacttcatagactcaagatttctcgaaatctgctttgtctcggaatcatccgcagcattaatgagactgttgtaatcagacacaaaagctgacaccttcttgtacgtagcatctgtatcgtccttgcggctgtttttgtaaagagcctgcgccgactttaccatgtcctctgactccgactcgatggacgcaagtgtcttcgctgaatccttagatgtagaaacagatgatgagacaagagactgggcctttgaattaaggttatttccataatatgacttgagaagcttgaaatagctgccacttctaatgccgctatatgtagtcatatccatattggcaataaaagacgatgctgcattgctgcttctactgctgctaaagccggaaaacagtgtggatatggatgacgaatcccacattcctattcctctcatagtatcactcctttgataatcatgtaatccgttaccttctatatatttttaatatagacgcttttccaatttatgtcaagataatatctgccggtattacccagcccggtattactaacatatgagccgttattgtcgtcctttatatatcctctatctgccagtcaacaggctccactccatgctccttaagaaactcattggctttgctaaaatgcttgcatccaaaaaagcctctgtaagccgacagcgggcttggatgcggtgctttcaatatcagatgctttggatttgtaagcataggaatcttcgactgcgccggacgtccccagagcatatatactataggtctgtcctgctcatttacagcctctatgattgcatccgtgaacttctcccagccgtgtccctgatgcgagtttgcctgatgagccctgacagtgagcaccgtattcaatagcaaaactccctgatcagcccatttcttcaggtatccgttattcgggatatcacaccctaaatcgtcgtgcagttccttgtagatattctgcagtgatggtggaatatccttctgagacggaagcactgaaaacgacaatccatgtgcctgattgacattatggtacggatcctgtccgaggatgagcaccttcaccttgtcaagtggtgtaaaatgcatggcattaaatatatcatctgccggaggatataccacatgtgtggcatattcatctctcacaaaattgtacaaatccctgtaatacggttttttaaactcggctcccacagcctttgcccactcgccgtcaagcatactcataatctttatctcccgcctatcttctgaccgacacacctttatctgccagataattctttaaatccataatttcaagctccttgtagtggaaaagtgaagctgcaagcgctgcgtccgcctttccctctgtcagagcctcgtaaaaatgctcctttgtgcctgcaccgcccgatgcgataaccggaacagaaacgttatcggcaataagccttgtaagctcgatatcgtagccatcctttgtgccgtcacaatccatgcttgtaagaagtatctctcccgctccaagctcatttgccttaacagcccattcaatggcatcaagacctgtatctatgcgtcctccgttcttgtatacattccagccgcttccgtcagcacgacgtcttgcatcgattgccacaaccacacactgactgccaaacttatccgcagcgtcgctgataagccgcggtgtgtttatggcacttgaatttattgaaatcttgtccgcaccctctctaagcagtgccttaaaatcatcgactgttctgatgccgccgcccacagtgaacggtataaacaccttttcagcaacctttctgaccatatccacaacagtatttctgttgtcgcttgatgctgttatatccagaaaaaccacctcatctgcgcctgccttatcatatgcggccgcaatctcaaccgggtcacctgcatctcttaaattgacaaagtttatgcccttcacaacacgtccgttattcacatcaagacatgggattattctcttcgtaaacatattatgccacccctatccctgcaaaatttttaagtatcgaaagtccgactgtgctgcttttttccggatggaactggcaggcgaacacattgtttttctctacagacgcatgaatgtgtgtactgtactctgtcgttgctgtgacaattgcttcatcagtggctttcagatagtacgaatgcacaaaatatacatacggatgctctgaaagacctttaaacagccttccattgttctgtaaatcaagtgaattccagcctatgtgaggtattttaagtccttccttatctggtatgcgaagtatctgtccgtcaagcacatgaagcccctcaacgccctgactctcatcgcttccctcaaataatagctgaagccccaggcatatgccaagaaatggcttgtccatgtcacaaacctcgtgaatcaccttgtccagctcgtattttttaagcgaatccattgcatctccaaaagctcctactccgggaagtattaccttatcggcatttaaaatctcatgcctgtctctggtcacaatactctcctcgcctatagctgtaagagccttttccacgcttcgcaggttgcctgctccataatcgacgattgctatcatatcattttgtctcctctttaatgcctaattcatttaatttctgtgtcagtgccagtgtatagtcatctctatcatctatattatatagagcaatggcatcatcatatgataagccatactgactgctcagggtatcagaaataatgttttttagctgttcaagctgcagctcacatccgtattcctttgcgttttctgcatttacagcacatcggccagccgcacatactaaggaatccgctgccatggttacatagcctgaatcgctaaagctcttataggcatcatacttacctgacactgatgcaagcaccgacagcttattgtacaactgcttatcttcacctgaaagcttcaagccactcagcctgctgtatgcctttgtatacaactctattgaatcagctttattctgacctatatcagctattgcctggttgtatgtattctgagcatcaatcactttagagttgtttccgagtaaaaaagtgcatatgaggacaaatacaactatcgacataacaaatacccagattactataacaggtcccttaggaagcttaggtcccttctcccatccaatgcgctccttcttttcctttggagcctttggctttttttcttttttaggtttttttggcttcttttcttttttaggctttttgcccctctttggcttatccgatgctttgtttggctctccgttagcatccagcgcttcaagtatctgtttattttcatccgagagcatctgtgcgtcagtttctgtgccatccgccatgccctgtgtatctgtaacgtcatctgactgtggctcttttgtaaaaaatgatattattctttttaaaaggctctttttttcagtatcttgtgcatcaactgctgcatcagccgtctcgtgcactttcatctggctgcttgcataatcatctatatcagcccctgtctcaccggtttttccttcaagcagatcaccgatattatccagaccatcactacccagtatgtcaagtatatcctttgatgcatttcctgccaaatccggctctcctatttcttcaaccatctgaggttcatttgttattatactctccggagtctcctcctgtttgggattctcagccatttccggcatgtttgcatccatcatctctatcccagaatctgccggtgtaaaattaaataccgcatcgcttagattatcgtctgctttgttttcctgtttatctccctgagtctcctgttccttcatcctgcggtcaaactcagtgagcatatcatcaagtgaagcatccttgtcatcaggagccggagtctgtacattaagagcctgacccttggcctgctcattttccctctcaagttccttttcaaagctcgacagatactcatcatatgtctcgttttcaagctcgtcctcaaactttttgaggaattcatcctgatcagccccagacatcttcgtatctgtatcctgcagcttattcattgaatccagcaaattgtccagatagttttctgtcgatttatcgctcattagtattctccatctataatccattaaagggtgcagctaaacaagccacaccccttgtatctaaatatattatgctttatcaatcagcttgtcaatcgcctctacaagctttccgatttcaggctttgtaagctgtgcgtctgctccaagctgttcaccctttttcctcatctcttcatttaccagtgaagagaatatgataaccggtatatctctaagctctgcatctgattttacaagctttgtgagtctgtgtccatccatgagtggcatctcaatatcagttataatgcagtcaagatgctttgtaatatcgccctttgcctgcatagcctctatcacatcccaggcctcctgaccattctcttccactatgagattggtatatcccgacttcttaaggcactcggtgatgagctttgacaataaagccgaatcctctgcgataagaattgtagcatcactcctatctcttgcctccatctcatcgatatcattaaccctaagtcctgtctgtggactaatagaagcaactatagcctcaaaatcaaggataactataagcctgtcatccattttgataacacctgtagcagtgctgccatgctcgcccgtcagtgtctcgtcaggctttatgatattctcccacgatacgcggtgtataccgataacctgatctacatgaaatgccacattgagtttgttaaaattcgtaatgataaataagcccttttcatccgtctgtggcagattaagacaattctttaaattgataaccgtaatcattgtgtcacgtggcataaatattccctcaacactcggatgagtattcggaacaggagtgaccggcatatattgcaaaatctctctgatctttgcgacattgattccgtagtgattgtctcccaacgtgaattcaagcacttcaagctcgtttgttcctgactccaataatatgttcgtatccataatacaacctccacctcttagtaatctaagtatatcatatgttttataattcaatcaaacttttttcgttatcttttataaccgacatcttaatattgtcacatgccgtaccctgaggtatcttgaaaagcagcaccacatcaaccgcatcgtgcgcctttacggttccctgaaaagtattaagggaatatgtaaggaatgtgccctcagccgtgtattcctttccatcggggaaagtggctttatatgtcctggcattgccaaacatatcaacatttatatcctcgtctgtcggatttttaagagtgaatttcataaccgcaaaagtattaccgcttcctgccgttatagaatagtatgagccctcattgtacacatctgactcgtttactccatcatatgtaatttcaaggctgccgtagcctgttgcctcggcaagtgacaccttcttttcctgcgtggcagaaggctctttctgcgaattgctgctcttatcatttccagcttcagatgtcttattatcctgcgaaagtgaattatcaggtgacgcctcgtccactttctcagtgtcgtcagcatcctccatatccccacgtttctccgtagcgttagtcatgccatcctgctggtatatattgtgttttgcaacaacatatgctgaataattagcgataaggccttgttccgcatcagtcatatcatataattttgttccgcagcctgtcaacgttataattgctgtaaatgccacagctgccatttttatatttcttcccatcattgcaataaacccattcttattctatgacttttatcctaataatacatatagtaacacatttattgattgtttgcaataaataactcaagttcaaaccagaattctacaccatccttgtgatttatgacaccataccctctgtgatgcagttccataattgcctttactatagacagtcctatgccgcttccgccatattcccttgttctggccttgtccaccttatagaacttattccatatattttctatatccttatcaggtatcggctctcccgtgttaaacacgctgaccctcacacggtcgctgtacatgctgtatgatacagtgatagtaccacctcttgtgcagtgatttatcgcattgctgatatagtttgtcacaacctcttcaatcttgtatatatcaccgctcacatatacggaatcagtgcggtcaaactcaattgcagcctcatttttctgtgccagaagcttagatgagtctataacccctctgacaagcggtgtcagatcaaacctcgtcatctcaagcacatcactgccagcctccagatgattgagagataaaagcttcataaccatgcggttcatcttgtcagtctcgtccatgatgacatcacagtagaagttacggctctcatcatcgtcatttacgacctctttgagtccctcagcatagcctgagatcagagcaagcggagtttttaactcatgtgacacatttgacaaaaactcctttctcatctcatcaatctcttcttttttctttatatcacgctgtaattcattgtttgccacctttagtcttgtgattgtctgctcaagtgtctgcgacagctcattcatatgctcaccaagcacataaagctcctttgcactgttttccgtatcaatgtacttcgcatcaaaatcaagcttcgccatccttgtcgacagctcagtcatatttcttatcggcctggtcatgttgcgagcaacaatatatgccataaacactcccacaacaatagcagccactccacctattgcaaaaaagcggttcgatatggacacgctctccttaatgctctcaagcggtgtcttcatgtatacaaagttaccgtcaatcagtctgttatttatgataatatactctgttcccagccttttatccttctgccttgtcatattcaggttgttgtagtctgccgaatatgacgacatgctcgcctccaaaagcagctggaatatttcctgattgtcagtggttccctcaatgatgaccttaccgtatttgttgaacacaaccgcatctatattggcgccaacgcatttcttttcaaatgctacagcaaacgtatcatctgaaagtttgtcattttttgcagccaggtccaccattttgtatacagcaagcatctctttttccttgttaaatacataatacttttccagcagtgtgttattagccatccagaacatgcctactatcagaagtacaatgaatgaaatcacaagcgtaagctgcgtggatagcgtttttttctttttcatggtgacacctcttatcccgaatccattagtcctaagcttagcacctactgtatctcgaacttatatcccacaccccagacagtctttatatagtcgcctttagcgcccatcttgcttcttaatttcttcacatgtgtatcaatagtcctcgcatcgccaaaataatcatagctccacacactgtcaagtatgcgctccctggtaagcgcaattccctgattgctcataaagtaatccaaaagctcaaattcctttaccgaaagttcaatatccctgccatcaatagctacagtgtgcgccgtcttgtccatgacaataccaccggcctcgcttattactgcctccttgcccagtttattcgccctgcgaaggagagcatttaccctggccaccagtatctttggagaaaatggctttgaaatgtactcatcagcaccaatgtcaaagccgtttaattcatcacgctcatcgcccttagctgtaagcataataatcggcacctttgaagtctgtctgatttcacggcatacctccaaaccatttatccttggcatcattatatcgagcaccagcagtgctatgtccttctgctgataaaatatatcaagtgcctcctcgccgtctccggcctcaagtacctcgtacccttcccttgcaagaaaatcatgcacgagctttctcatcctgctctcgtcatctaccaccagtatctttattttgtccactctgttgcatcctgcctttcatccagtgctttttccctctcttctactgccttttcccttttttcaagctccttctgccagttttcatatttgtctatcagctcattctcgtagtccaccacatacggactgtgtccactcacatatgtgatgccaaacataacagctatggcagccgataatacaatagtaaaaaacaatgccacatggaactttttcttatagccttccgtctgtttttttacctcgacaaccgcttttttatcctcaggaatataaatcggacggatatcctcattcttgatatatgggattgtatgcagatattcctgcagttcaacaagaaacgatagccctacaggagtaaaaaaataccccggcctgttaagccttaaatacagcttgtataccgtatccgggtcagacatatcagtctgatcctttatatatcgtattccgtcactttcttttttagcctgccttgcctcttcctttgtctgaaactcaaacccatcaactacatacatcatatcccctctttctaatcatcgcgctctgcaatctcacccgaacgatatgccgcaatgagatgctttagatcagctatcttttccttcatctttattccggcatccgtatctccgacaagtattctcttatcaagtacctctacagcctcacgccttgatacgatatccctctcatcccttactgccgtctccggtgattcaaacggctcatgtgctgtcaatgtcagcccatatgaattgtaaatcaaggtatatcccgcgatgcctgtccgcctgcggtacgcctttgaaaaaccaccatctatgactatcactctgccgtcgcacttcacagggctttcacctcttaatctgtgcacaggaacatgtccgtttatgatatggtctcttttatcatgcaaaccaaactcctcgagtatacgctgcgcacactcaggcttgtttatatagtcataataaaagtttttcttttctattttcatatcatcgtcatctataaaatatctctcaaacgtagccatcttatttctgccataaagcggagaatatggtgctgtccatatgtaccacatgatatcgctgcccttttgtctttccagcctgtcgtccgagaaaaaagcctttctgacgtaagtctccagtatatcaaacaaagccttgccactatactctttaccgtagatatttacctttgcgaaacttccatcctcctccatcgggatgcatccgtggaaaagcagattgccattatataccttgtacatgctgcctcttttaagcagcagcccaacgtggtttttaagcttctcacaatgaataaacgagctcctgagcctctgtatgacttcctcttccccctctgtcagcctgtaaggatcagccgggtcaattgtcggaaagcttgtatcaagaagcttataagttctgccctcaagctctatagtgccctgttcataatcaatatgttccaaaagcaatcgttccttcatgccatactcaggccacttcttaatgagctgtccctccagcttgaaacgtatgatggcaatggccttgtgcatcttctttatcagatcactctccatattatctgcaccacttggagccaccttaaacacaaatctggtgcatgggtcatccttgtaagccttcagtgcaaacgtagcaagcggaagcatatttatgccataaccctcctcgaccacgtccagattaccatatctgatactgtttctgacaacagttgcaatacatgcaggatttcctgcggctgcccccatccagataatatcgtgattgccccactgtatatccaacgagtgatatctgcacagtctgtccattatcagatgtggccccgctcccctgtcgtatatatcaccaagcacatgcagatggtcaacagcaagtctctgaataagctcggaaagcaccactataaactcctccgcagtgcccagctccactgttgtattgatgattgactcgtagtaagcctccttgtttaacacctccggcttttctgtgatgagctcctctataacatatgcatactcctccggcaaagcttttctcaccttggagcgcgtatactttgatgaaacggtcttgcacacctctatcagcttataaagagtcgtcttataccacgagtccatatccggctcgtcctgcttaataagctccatcttttcccttgggtagtagatgagtgtggcaagcgcagccttgtcagccttgttcatcgccagaccaaatacatcatctatcttctttcttacagccccggaaccatttttcagcacatgggaaaaggcttcatactcaccatgcacatcagatacaaaatgctctgtgccctttggcaggtttaaaatagcctgcagattgataatctcagatgatgccttgcctattgtaggatacatctccgacagctgttccaaataatgtaagtgttctttatcaattgctatatcattcatttatatctagacctcgtaatactgattcatcaccttatatatttccttttcaagcttacagcccgtgtatacacacttcataatgcactttctgattggttcctcaaaatcagtaccctcgcacttatccaaaactccctgcaatgtaagctgtacaagtatactctcccctgtctgcggatctgtggctatgttttcgtacaccttcttgtagtacttatcactcactaccgggtactcagtcagcgccatttcccgccactttctgaaatttagcgacatatgttcacctgctcttttgtatataataaaatattgtaccaattagcggtgctctaatcaatgcctcagacacatttatttcaaaaattttttttgatatttattataaatgaagctgcatttgtttaaataaaaaaagtgtaagctgcattcagcttacactaattaagtttcaggacacctccctttttatataacaaacattcttatttgacagtaattgacgtttcttatatatttatttatgtttcaacaataaccattatagtttattgtgcatgtcaatacttgaccaaatttggagtttattttttaaaaaagaagggagattagctcataaatgaaccgacttgaaatagcaaacaacatatcgacaaatattgagcgcgaacgcataaagcttggtatgtcccaggcacagtttgcaaaagcacttgatatgtcactctccacctacaagcgaatagcaaacggagaatcctctcgtatagacatctacaccgcttacctgatacacaagctgacaggacgattttcctgcgaactaacaggcttcaatgatgatgtaataaaccttgtaaagcgcatcaaaaagctttccaaaagccagcgcatacttatagactcgattatagacactgagcttgcgctatctgcctacaaggatgaaagcagtcatacggaggatctgatttccgtcctcatcccgacaggcaatatgaccgacggcatgattttggactcctacaatgtcgaaaagcttgatgtttcaaattacagaaaagccttcggtgatgcccttcacatcggaatccgcatcacaagcaatcatctacatcctgtatataataaaggcgatatacttctaatcagtcgaaacccaatccgcgacggcgataccggtatctttatcaacgcacagaacaagcgtgcatacatcagaaaattacaccagacaaacccatgtgagctcacaccaatcaacaattacggtgagaccttttatgtcgacagcgataatgttgatgatatgagcaaatggataaaattcggacacgtgctctgcaaggtgcgctagcagattactctgttattttaatatcatcaaagcagtcaaaggttgcaaagtagtctgccggagtttctgctcttctgatgagttttgcctctccattgctttcgagcagtatctctgctgagcgaagtcgtccgttgtaattgtagcccattgagaagccgtgtgctcctgtatcatggattaccagatagtctcccatatcaatcttcggaagctgtctgtcaattgcaaacttgtcacagttctcacagagtgagcctaccacatcatatgtatggtcacaaggtgcatcctccttgccgagcactgtgatatgatggtatgagccgtaaatagccggtctcataaggtttgccgcacacgcatctactcctatatactccttgtagatatgcttctcatggatagcctttgtcacaagacagccatacggagccatcataaaacgtcccatctctgtgtaaatagccacatcgcccattcctgccggtaccaaaacctcatcgtacaccttatgtacaccggcgccgataactgatatatcgtttggtgtctgatccggcttataagccacgccaactccacctgaaagatttacaaatctaatatcacatccggtctcatttttaagctcaacaaccagctcaaaaagctcctttgcaagctgtggataatactcgttggttactgtattgcttgccaggaatgcatgcacgccaaagtatttagcgccttttgacttaagaattttgaatgcctcaaaaagctgttcctttgtcattccatacttggagtctcccggattgtccatgataccgtttgacagtgtgaacactccacccggattatatctgcagcttattgtctccggaatatgtccgattgtttcctccaaaaaatcaatatgtgtgaaatcatcgagattgatgatagcaccaagcttgtctgcatatgcaaattcctctgccggtgtatcatttgatgaaaacatgatatgctctccgtcgaagccgcatgactttgcaagcataagctctgtatatgatgagcagtcacagcccatgtcataatcctttaaaatcttgagcaggtatgggtttggggtagcctttacagcaaaatactctctaaaacccggattccatgcaaatgcatcctttacagcctgcgcgttggcacggatgccagcctcgtcatataaatgaaatggtgtaggaaattgtttaacaatctcctctacctgttgttttgtcacaaatggtgtctttttcatgtttatctcctaacttttacatagtaaagtgtactaaaacatatgctacaacaaaatgggtatattttcaagaatttttatggtataatttctcattaggtaaatgtctttacttttttaagtatagttgatataactattcaaaactgatataactatttaaattaagatataaagggaaacaggaaaatgaacattaaagtacttcagtatattgataatacaccaaaaaataatataactaccggtcaggctgctgtaaccggtgataacattccttccaatagcagctccgctgtcaatagcaccggtgctgattttgatcaggtgcttgacgatgcaaaaatggctgaagctgctgttgccattgacagactgattgcccaaagtaacggtggctcagttgatatgtcgcttgtacagaggttctttgatcaaaatggtataaatatcgagctttgccgtaatacagtttctccttctgccgcagttaataatacagctgcttattccggttctccagccggcatcagctcagatacaaatacatataatgcagcagcttccggagcctcaggaattagcagcagctccgtaaaactcgaagcttccggtttgtcatgctctgccgatcttgatgcaatttttaatgaggctgcctcaaaatacggtgtggatgccaaattccttaaggctatcgccaagtgcgagtctgacttctccacagagtgcaccagccgttcaggtgccatgggtatcatgcagctcatgccacagaccgctgcctcacttggtgtcacaaacgcctacgacccataccagaatatcatgggtggcgccaggtacataagtgaaaagctcacccagtataatggtgacaaatcactggccttagctgcctacaatgcaggctccggcaacgtagccaaatatggcggcattccgccatttaaagaaactcagaactatgtagcaaaggttatggcatactataattcataataaattgtattctgactcacataaaattatattttaattcaaagtggcttgacaaatgctgatgtatatagtaaacttagcaagttgatagttgctgatgtggctcagaggtagagcacttccttggtaaggaaggggtcacgggttcaattcccgtcatcagcttatttaaagaaatagttattttatatattgaatgccacagacataaagctgtggcattcaatgtatatgaggaaaagcatatgcgacgtcaattctgtgcacatgaataatttttagtcggaactgagtgtaccccaacacatagttgaaatacaacagctccttttgatgatattatagtaacacttaattgtgtcctaaatatagccatgtgataaatattttcttaaatttggtaaatatctacaaacaaactcttaatccggcagaaatattctatatttcaacaatatatttctcgtatgcattgataacagtagtttctcccaccttgtcaagcctgacaaactgcctgccgtaactcatatgaacatgtccatgcacaaaataccttggcttatactgctcaataagcctgttaaacacatcaaagcctgtatgacatgtatcctcaccatcatgcagtccctttgccggcgaatgggtgacaagcacatcaaagccgtttttacgtttaagcttccaccacagcttcttaacacgctttgtcatctccttctgagtatactgattttctcccggtttataacggtttgagcctcccaggccaagaaaccgtacaccctcatattcgtaaatctcatcctcaatgcatatgcagccttccggcggctttacattgtatttgtcatcgtgattgccatgcacatacaaaagagggactccaaccatcgttgtcagaaaggacagatagctcgggtttaagtctccacatgatacaataatatcaattcctttaaaatcctctttcttaaagtattcccagtacattttcgactcttcatcagctaagaatagtatcttcattacagtttattttcctctacaccctttagttcaaccaccatctttgcattgtcaacaaactcactcataggcggaatactacctacaacattatctacaagccagtccattttcatgatatcagacggtttcatctcgtgctcacctttgtttttaagctctcccttctggtcatatatctgtccaaagaaaggtacaacctcgccctttgtgatatcgctctttaaatgatccgcaagcctctttactccataaggtacatgctttgaacaaatcaggtcaataacacctgcagacatgccccaccagtaattaagtgccttaacctgctcctgtccctcagccttgtaggagcctgccagtacgctctgcaaaagtttctcataaaacactccccagttccatataggcatggcaaggtttaatgcctgtccatcctgcagcttgtacagaccaaaatatctggacgcgtcattcggagtgataatatcctgatccgacacataatgcaggtcattttctgtaaggaatttattcctgtcataatcctttgtctttgaccatgccagatatacctttgcccttggattcacacttgcaactcccagagcaaacgcgttgatattggcaatcatgccatatatcgggtagtctgcaatatatgcaaccctttcattgtctgtgacagctcctgctatcattcctgcgagaaactttgcctcatacatacgtccatagtatgttctgatataaggatgaggcgcattcagcgaacagttgagtatataaacctccggatgctcaacagccacctttaagctgtttggcatcatctgcggtcccacacaaaaaattatatcggcacctgcctttataatatcctcaagcacctgctccacattgttctcatccacacctgccacatattctgtctccagcttgtcagaaaaggtttcatcaagatacatacgcccaagctcatgcgaatacagccatgcagatgtctttggctctctcggatacaaaaataccaccttaagcttcttcggtgtctgaggaatcagataattgagcagactctttttggtctgcacctttgtaggatccagcacgaggtttatcttgtgcttttccccttctgctgcaaactccttccatgtattgataacgtttttgttgtaatcattctcagacatctcaagcatggcatccatgccaaagacctccataaatactgtaatagcatcacccagcttaatgtccagcctgtcaccaccgcggaaattatagacctttgaaaaatcaaacattaccttggcaaatttttccttggtctcatcatcccatctgccctcttttccaacaagcgaaagaagcttatcagcattgcccagcttcgtaaactccaccgagcaaagccccgtgatttcattgaacttcatatactcataataaagcctcacatcataatcatccgacagctttggaatctttctggtcacaattgcaggaatcgaaacggcgttgaagtacttgagtacactgaccctcttattgccctcaagcacataatacctgttcatgtactcaaatgccttgattggatctctgattccctcattcatctgtgcatctgacagattagaccacttcactgcaaattcggtttcccagtccaatatcggcataaaatttgccgcaaatgaatatgtcctgcccatggtgcttgttcctacaacgaaatccaaaggcacatggaccagccccatattctgctctgtctgaatatctgcctctgataagatttcatcaagcactggcagataaggaaactgtcctttagctatccttgccctgtattctttttttcccagctttaatgcttctgaatattctgtttcacccatattgtaatctccttttgaaactattttaacataaattcaaaaaaattaaacatttcctttgatatttttaaaaactctgatataatatatgttaggaaataggtaccacagtcatatggaggataaaataatgcaaaatatatctcgggaaaatgccgatatcataggcgaagtagccaatatctgcataggcaatgcagccacaacactgagcatgattctacaaaaaccgacaaatattacgactccgattgtagaggttttgaaaaaagaggatgctctcgatcatgatgatcgaattttaattaaggttccttacacaaaaggacttgacggaaccaacctacttattataaaattaaatgatgcattggttattgccaatctcatgatgggaggcaacggaagtaatgtttctgatatgacacttgatgaaatcacactttccgccatatcggaggctatgaaccagatgtgtggtacaatagctacatcaatgtcttcgctcttaaacgagccaaccgacataggttttccgcttatcaattcaagttatcagaagacctttgatataccggacgagttgtgtaacggaacagatattgtcaaggtgacattcaggctgactgttggagatttaatagacagtgatctcttacagttgtatccaataagcatagtaaaacagattatcaaacaggaggtttaacaaaatggctagaattttaatagttgatgatgcagcatttatgagaatgatgctgaaggatatccttacaaagggtggattcgagattgcaggcgaggctgctgacggaaatgaggcagttgcaaagtacaatgagctcaagcctgatcttgtaacacttgacatcactatgccaaataaggatggcatccaggctttaaaggaaattaaagcagctgacccaaatgctacatgcgttatgtgctctgctatgggacagcagtctatggttattgacgctatccagtcaggtgccaaggatttcatcgttaagccatttcaggctgaccgtgttatcgagtcaatcagaaaagtacttggataatatttacatacaaaacaaggtctgtcagtatagctgacagaccttgtttttattatatttttgtaactgttcagtacatttacagctgcgcaagactctcaatagccttgtcatcaagaataacctttgcatgctccataagaaaagcccttttgtcagcccctgcaatgatatcatctgcatactcatctgctatgacagacatcttttcaagctcatgctcatcatagcccgataaatccatgctcataaagtactctccctcaaacttaaaaagctgtgagaatggcattggcagtcctttaatcatctttgcaaatctgacagccacatcaaatttttcaaaaatgaacattacaacagacaccatatcctgcttttttgcagttgtcctgccttttttatttttctcattctctgcagccccggccggcagcgaattaagcaatccattaacgatatctttaagatgctccatcattccctcagtagcaggatgttcagaaaatgtcagagaaagtgtgtgatccgccaaaaaatctgctctcacagtcttgattcccgaattaaaatcagttccaaactcttctgaagccatgtcaaatatctggttcatgaattcctgggtgcgctcgccattgctcataatttcatccattgtatatcccagatcatatatttcttcttctgaaataacacattttatagtgtgttcacctattcttgaaaactccataacaagcttcacctactttctttttagcttttgtctgatacgggatagtgcattgtcaattgatttatctgattttccaagcatatgcgctatcgatgtataattatttccttccagatacaattgtagcacttttttctccatattactcagtttattccacaattgttccttaaattccttaaatttttccttctctatgagaagctgctcaggacttgcaatatcatcttgcagcatttcctcaaactctgtaccatcactgtcactctgtgaaaaggatatatatgtgttaagcggcatatgtttctttcggtttgaagcctcaagcgccgagctaagctgccttgtgatgcatagctgtgcaaaactgtagaaagatgcttccttgtcgctcttatagtctctgaccgctttaaacaggccaatcatgccctcctgaataaggtcatcattctcaccgcctatcaggtagagtgcattcgtctttttacgcacaagcggcttatacttttccaatatatagtccatgatttcattgttgtcaccatggtcatttttgtcattatgaatcctcataataagctcttcatccgtatatgcgctgtaatcttccactatatgcttcctattctataaatatacaattcataatacacaccactcatcccgcgacatgtaatctactttccactcttaagtctctgtctgactatctcatatgcaagcacgcctgtcgcaaccgatgcgttcagtgagtcaatatcgcccaccataggaatagaagctgtcatatcacagttttcctttacaagcttgctgactccgtcaccctcattgcctattacaagacctataggacctgtgaggtttaagtcatacatggtagtgccacccatatcagcacatacaaaccacatgcccttttccttaagctcctttatagtatttgagatattggtaaccttggcaacaggtgtatagtttatcgcacctgcagacgtctttgccactgtaggagtaagtcccactgcacgcctttttggtatgatgatgccatgtgcacccgcctgatttgcggtacggattattgcaccaagattgtgtggatcttctataccgtcaagtatgatgataaaaggcggctcgccctttctttcggcattttccagtatgtccgaaacctcggcatactcatatgctgctgaaactgcaatgacaccctgatgcttgcctgtctcagacatctgatcaagtctttcctttgcaacatagtttatgattgcatcatgctttctggcctctcttgtgattgactttattggtccgtcctgacaaccgtcaagcacaaaaagcttgtctattgtctttcctgaacggaaagcctccagcacagcatttctgccctctatataattctcatgaaatttttctttattgttgttatccatattttcctcttattttgtgctatatttcaattcctaaaagctccactccaagcttagtgagtgaaacaaccctctcaaaatcatccttcagataaagatagcccatgaccgcctcaagccctgtagccttcctgtaatcagccattgtagcgttttttgccatggaaggcgacttggcattgcgccccctgtgatacacatcactctcctcctctgtcagatgaggtaaaagtgcctctatcatgagagcctgcgtatgtgcctttactatattacttgtgtgcttatgaagcagatttgcctttgtattgccttttcccaccacaactgagcggatgacaatatcaaatatgccatcaccgatatatgcaagtgtaagcggcgagtatgtccttatatcaacatcctttattccaaactgttccttaatatatgagtctatcttcatactatacaagctcccattttactccctctctggtatcctttatggcaaccccctttgccagaagctcatctcttatggcatcggctgtcgcaaaatcctttgcctttttagcggctgcacgctctgcaattttatcattgataaatgcctcaagctcactgtctacagatgacgatgcctcaagtaaggcctttcctgattccctaagtcccagatcaagtacctgctcaaagtcatcgataagtgcaagctttgtcctgtctgagatatcagccttaagcacatcatacactatggttatagccattgatgtattcaaatcatttgaaactgcatcagtaaatttcttcttaaagtcagcaaaagctgtctcatcaatatcaccctcatccttaagctctgccacacgctttgcaatcttattgtatgccgcaactgcattgtcgagcgcatcaaaagaaaactcaagaggctttctgtagtgtgactgtaaacagaagaatctgtaggcaagcggattgtagcccttctcctgaagcaccgaaactgtgaggattgcacccttcgacttgctcatcttgccggctctgtcatttaagtgattgacatggaaccagtacttgcaccagtcgtgtcccagatagctctctgactgtgcaatctcattggtgtgatgtgggaaaatattgtccacaccgccacagtggatatccacgtactctccgagatgcttcatgctgatgcatgagcactctatatgccagcccggatatccgacgccccatgggctgtcccatttaagagcctggtcctcaaacttagactgtgtaaaccagagtacgaaatcatttttattcttcttgtttacatcctcctcgacatcatctcgcactccaacctgaagctgttccttctctactgctgaagagaacacaaaataatcatcaagctttgatgtatcgaaatatacattgcctcctgcaaaataggcatagcccttctctataagcacctccaccatatggatgaattccggaatacagttggttgcaggctctacgacatcaggcattctgttgtgtacggctgtaaaatccttgaaaaaggcgtccgtgtactcctttgctacctccatgacgctcttgtgttcacgctttgcgccctttagcatcttgtcctctccggtatctccgtcgcttgagagatgtcccacatcagtgatattcatgacacgctttacatcatagcccacatagcgaagtgccttctcaagcacatcctccatgatgtatgagcggatatttccgatatgtgcaaaatggtaaactgtaggtccacatgtatacatgccgattttgccgtcaacacgcggaacaacagtatcaatctgtcttgtgagtgtattgtaaaacttgaaattgttctccattatttatatctccttttggatgatttataattatctttttattttagcatgttttccctatatattcaaattaatcggcctgacagccactgcagccgctgcatccgcctccgacctgcacgcttgcctcatagagacctgtaagtgagcagattgcctgtgatgcaatcccctcctcgcggcctgtaaaaccaagccactcctcggtcgttgcctttatatttacctgctcctttgcgatttgcagcgtatcagccacattctgctccatctgctcaatatacggacgaagcttcggcttttgtgcaattactgtcgcatctatgttttctatcacatagcctttttttgcaatgaggtctctcacatgctctaaaagcttaagactcgaaataccctcatatgccgggtctgtatccgggaaatgctttccgatatcgccaagtgccgctgcacccaagagtgcatccattattgcatgcaacagtacatcggcatccgagtgccctaacagcccaagtgtatgtggaaccttcactcctcccaaaatcaaatctctgccctcaacaagcttgtgcacatcatagcccattcctactctcatatatcgtctctctttctatcagatacaacacctcatgttattgtcaactgtcattgctctgtattttagtttttaactatagtataccttatttcttctgttgcgccaagatattattttaagctattttcaaataaaagaccgccccggacaaaccggagcggtctttattaaaatggaaatagtccattaaatgcttatgcaagtgctgcagtgatgatagccattgagtaaacctctcctgcattacatccacgagaaaggtcattgattggagcattgagtccaagtaagattggtccatatgcttcgaagttacccattctctgtgcgatcttgtatccgatgtttcctgcgttgatatcagggaagataaatgtgtttgcatgtcctgctactactgaatcagggcactttgtacgagctacacgaggtgcaactgctgcgtcaaactgaagctctccctcgataggaaggttaggatatttctccatagccttgtgagctgcgtttctcatcttgtcaacatcctcgccctttcctgagccaagtgttgaatagcttaagaatgcaacctttggatcgataccgaagatcttagcacactctgctgtttctccggcgatttcaacaagctcgtcctctgtaggatggatattgatagcacagtcacccattgcaagaacctcattctcacctgtagcagatggacgaacaaggataaagcatgaagaaacgatagcgtttcctggctttgtcttgataagctgtaatgccggacgaactgtatctgctgttgagtatgtagctcctccgagaagtgagtctgcgatacccatctttacaagcattgttccaaagtagttagctgatgaaagaattcccttagcctgctctggtgtaacacccttgctcttacgaagctcgcagaataattcaaccatctcatccatacggtcaaagttcataggatctataatctctgctccacggatattgaaaccgctcttctcagcgcttgcactaatcttctcaggatctccgacaaggataggatgtaagaagttgcttgcaagtaaacgcgaagctgcctcaaggatacgtggatcctctccctctgtgaatacgattttctttgggtctttctttaatatttcgattaactgaccaaatccaaacatgataatgtctcctttatgtatattatttattatttaaaactatatctggtttcacaccactgactataatatacttatttctctcgaatatcaataattgttaaaaggttgtcaagatgttcgcgaaaaaatccaatccataatatttcatggcacaataaaaggaaccggattaatattttccgattccttttataatgatcactatttattcgtttaaggagtatttatcatgaaaaaccatttactctgcaagtgccttaaatgcctcatcaagatcctcaattatatcatccacattctcagttccgattgaaagacggattgtgtttggcttgatgccctgatctaagagctctgcttcattgcactctgagtgtgtggtagaagccggatgtatagcaagtgacttaacatcagctacgtttgcaagcagtgagaaaagctcaaggttgtcaataaatttctgcgcttcctttgctccacccttaatctcgaatgtaaatatagagcctcctccgttagggaagtatttcttgtaaagctcctgctgctctttatcctctgaaatagatggatgattaaccttctctacgagtggctgatcctttaagtactgaactaccttgagtgcattctcaacatgacgctccacacgaagcgaaagtgtctcaagtccctgaaggaagataaatgaatgaacaggcgaaattgttgctcctgtatcacgaagtaaaattgccctgatatatgttgcaaatgctgccggtgcgcaatccttcgcaaagcttactccgtggtatgatacgtttggctctacaagccatggccatttatcattctgtgtccagtcgaatttaccgctgtcaattataactccaccaattgttgttccgtgtccaccgatgaactttgttgctgagtgaaccacgatatcagcaccgtactcaatcggacggacaagatatggtgtagcaaaggtattatctacgataagtgggattcctgcctcatgagcgatatttgcaattttttcgatatctactacctctgagtttggatttccgagtgtctcgatttcaatagcttttgtattctctttgatggcagccttgattccatcataatcgaatggatctacgaatgtagcctcaattccgtaatcaggaagtgtgtgtgccaagagattgtatgtaccgccgtagatattctttgctgcaacgatatggtcacctgcgtgtgctactgcctggaaagcatatgtgagtgccgctgctccggaaccaacagcaagtgctgccacgccaccctcgagtgctgcaattcttctctcaaatacatcctctgtagggtttgtcagtctgccgtagatatttcctgcatctctgagtccgaatctgtctgccgcatgctcactgttatggaacacatatgatgaagtaaggtagattggaactgctctcgcatctgtaaccggatcaggtgtttcctgtcctacatgtaactgtaatgtctcaaattttaaatttctgtctgcataatgtttcttgctcatattaatatcctcctattaatgatatgttaatgttatttgtttttaattttaattccgggatgctgttcccttgaactaatcatatcatatcatctttctaggaaaagtgttaatacttataactaagagcttgctataaatatattttataagcaattgttttccaaaacatcagaaagctctctagtagctgcaccaacatccatgttatttactgcataatcacatatctggcggttgcgtttctctgcatctatcgacagaatacgcagtgtcttttcttctattgagtaatcctgttctatgatatcccggattaaaagctccttatcacgtgccacatacactataacagtaggaaaatggcgcttcatggcaatggcgccgcacatgtcaagcggcatcacgacaaagtgtccctttgcaagcaccgcctctatatcctccattttggtgccatactgtattcctgcgtatcttgtcttttcaaagaaatcctgtgcattgaactcctcctccgtcaggtacctatgcttatctccgggcttggtacagtatgttttcggattctcaaactgctccatggcgcacaggctgtctgagagcgctgtttttcctgagcctgatggtccgacaagcgccacaactgacggattctttatatttttatttctatataatgacgcatttattatctgctccacgagatatacaaactctgtgatattattgaccgataacagtcctgtcatttttgaattccacggctttcgcatgagcacgggatacgtggccggtgtctcaagcacattgtgtatggcgtcatctaaaattatatcaaactgcacgagattttttgcattgccaagtatgatattttctgtcgggaaatcaggaaatgcctccattatctggctcgccctcactcccatgaagcccggtgccaccgccgtgataaaatatacctctccgatatccatgagctttcttatcatccgctttgtctcttccgtaggcttctgcctctcgtaaagtgtattatcccggtaaaattcctttatgacagaggctctgccggtattctcccaggaatctatatcctccagttcaagcggtggggtgatattatattttttgtttgccatatctatggctatgctgttgaatggggctgtcacatcatcccagtcaagtcctattttaggtcttatcatgcttatccctttctgtttcgtaactatttataacaaaaagacctgcaacaactgcaagtcttaacaagtagcgagggagagactcgaactctcaacctcccgggtatgaaccggacgctctagccagttgagccacctcgccatatttgattgatacctttaaaaggatgggacctacagggctcgaacctgtgaccctctgcttgtaaggcagatgctctcccagctgagctaagatcccgtgtcacttctattgaagtaaagtagcgagggagagactcgaactctcaacctcccgggtatgaaccggacgctctagccagttgagccacctcgccatattgattgatatcctttaaaaggatgggacctacagggctcgaacctgtgaccctctgcttgtaaggcagatgctctcccagctgagctaagatcccatgtcgtcaaccgacttgattattatatacagtcggcaccttattgtcaacaactttttttcattttatttaaaaaaatttcaactattcagaagtctctccacaagcttcacgcactctgccgcatcctttgaatatccgtcggctcctatctcgtctgcaaagctttgtgtaatgcaggctccaccgattacaaccttgctcttacagcccttttccttgcagatttccactacatccttcatgcgcatcatggtggtagtcataagagctgacagtccgataactgccgcattcgtctcaatcgccttgttgacaatatcctcacaaggcacatcctttcccatatcaatcacgttgtagccatagtttttaagcataagcacgacaaggttctttcctatatcatggatatccccctccaccgttgcaatgacaagagtcggcatatcatcacctgagtccttcttttcaagtaacggctccagatgttctatagcaagcttcatggtattcgcactgccgataagctgtggcaggaaatatttcttctggttaaaaagctctcccacctcattaatagccggaatcaggctgttattaataatctcgtcaggttttgccccatcagaaagcattttctttacttcatcaattatactgcccttgtttccctttaagacagcctgaaataccgcatccttaccgcccgctgcgcatgtaccgtttgaagcagacgcatcattgtccgactttttcacaacaacagtctcatattgggccttttcctccgcaagcctgctcatgcgctcaatgtaagcaatatcgctgtcaggtctgtcgagcagcatatcagatgcaaatgccgcattcatcaaaagctcctgtgatggattggcaatagccatggtgagtcccttgcatatggccattgtaagaaacgctgtgttcacgtacatacgctcaggcagtccgaaggatatatttgaaagtccgcatattgtaggaagctttttctcatccttgcagtacgcaatggtctcatagcactcgattgcggcctttggatttgcacctattgtcgcaacaagtccatccaccacgatatcctcatgtgccattccaagcgaaagtgccttgtcataaatagtatttataatctgctttttttcctcaacatccttcggcaaacctgcatccgaaagcggtaaaagtatgaacattgctccgtattttgccgcaagaggcaaaagcttttccatcttttctgtctcaagggaaatagaattgatgagagctcttcccggataaatcttaagagcctcctctattacctccacatagcttgaatcaatacaaagtggacagtccacggtagatgaaacctcatatataaccgatttcatcatctccttctcatcgataccattcatgcccatattgatatcaagtattctcgcaccatttgtctcctgctccatagccatctggcgcaccaggtcaagctttccctcacgaagctgtgcctgcagctttttcttgcctgtaggattgattctctctccgacaacggtaaagttgccatctaagtcaatctctacattctttcgttcagacgcaagcactcttctatgatgctcaagcggcttatgaacaggcattgactttacggcctctgtcagtgcacgtatatgctccggcgtggtgccacagcagcctcctacaatggatgcacctgccttcacaagccctctcatcgcatcggcaaacatatccggagtcatcttgtatacagttttaccatcctcaagctccggaagcccggcatttggctttgcaataagaggcactgtagagtactctgccattttctcaaccagcgctatcatctcagcaggtcccgtcgagcagttcacaccgatagcatccactccaagtgactgcagcacaacaactgctgtctcaggcggtgtaccaaaaagagtcctgccatcctcgttgtaggtgagtgtcaccataataggcaggtcgcttacctcttttatcgcaagcactgccgctctgcactcctgaagactcatcattgtctcaaccacaaaaacatctgcgcccgccgcatcaaggatcctcgcctgctccttgtatacctccaaaagctcctcaaacattagatccccgagtggaaaaagctgtctgccggtcatcgtcatatctgctgctacaagtgccctatccccgacagcctgctttgacaggccaacaagcgtggtgtttatctcgttaattttttcctgtaaaccatattctaaaagcttaatcctgtttcctgtaaatgtaggtgcataaacaatattcgtgccgttatcgacataagccttctgcaaatcaagaatcaccttcggatgctccatcacccattcctccggacacacacctacaggcatgcccgctgccatcaggtttgtaccggtcgctccatccaggataactatgttttctctaatatattttctgaattcttctcttgtcatttcgtttccttttctgtttcagctgttattcactccacagtgtaaagtatttcaaagcaaaagctatgtgctcttcatccttgaaatttgtgaaaatttatattatcattgtaaccgattttaaaacacaaaaatcaatagtctattcaccataatatactaaaacactatatttttcaaacaaaagaaaggatttcttatgaaacttattgctttagatcttgacggaacacttttcaacaacaaaagtcagatatccagggaaaatataaaagctataaaagaggcaactgctgccgggataaatgtggtcatctccaccggccgtccattcggagggctgccgtttgaggcaattaaggacaccggcatccgctacgctatcactgcaaacggaagtgcaatctacgagattgacaccaaaaaatgtctttacgaaaactgcctttctgatgagacagcgttttcaataattgattacctgatgacaaagcgcgttcatatggatgccttcataaacggctgtggctattctccatacaagtgtctcgaggatgcaaaggatctcaaaatgcctccttctataaaggaatacatcatgacaaccagaaaacgtgtgaacgatatcactgaaatgatgcgcgaaaacaattaccatatgcagaaaatgaccatcaatttcccaaaggatgtagatgataactactactgccgcgacgaagtatttgagcatctgaaaaaaatccctgaaattacgctcgtaagcggtggctacggtaatctggaattcacaaaagcaggcgttgacaaaggtgtggcacttcataagctggctcaaatcctgaatatagcagctgatgagacaatggctgtcggtgacactgaaaacgacatggctatcgtaaaagccgcacacatcggcgtggccatgggaaatgcaaccgatgagcttaaggcacaggctgattacgtcaccgacacaaacgaaaatgacggcgtagccaaggctatccgccactttatgggttaatctcacataattaaaataacgataccggtcatataagagtataatagttgtttagcgcaaaatagctgtttaactcacaataaataatcacctgtcatatatatccaaagaagcacatatacttctaagacaacatatgacaggtgattttttgattgtaaaaaaatatttatccaatccacttgtgaccggaactattttcctgacacttgccggtacaaccagtcggtttatgggttttttctttcgcatatttcttaataacgtcatgggttcaaccggtctgggactctatcagcttgtgattccactcatgtccgtatgcatgtcactctgctgcaacggttttcagaccgctacatcaaagcttgttgccgaaaagcctcaaaacaagcagattatactcatttgcgcaataattatgtcagccaccatcgctcttttactcacaattattatgtattccaatgccaactacataagcctttgtattttaagtgagcaacgctgtacagagcttgtcaaggcgctgtccttttccattctgcccgctgctatccattcctgcataaacggatactattatggattgaaaaaagcagccgttccagctgccactcaattaattgagcagaccgcacgcattggcacctgctatctgatatactcaatactgtctgacggcgacagctgctttaagcctgtatactctatatacggcatcgtggcaggcgaagcgagcgcaaccgtcttttccgttatcacaataaaaaaagatttcccatactttaaaatatccgtcaaaagcctgaaaacaacagcctatgtcatggctgcgcttttcatccctttatcacttaactacatattggcaagcttttcatcctcagtcgaaaatgtgcttatcccgagaactcttaagctctacggactatcaccggcattggcccttgacatattcggaaccatttccggactcacccttcctgtgcttttattccccggtgtgctttgcagctgtgcctgcgtgatgcttctgccatctgtttctgaagcgaatgccgccggaaaggatacaaaaatcacaaaaaccataaactcctgtgccttattcggactatgctttggacttatctttacatgcatattctatctgctgtcggattttataggggtttttcttttctcatcgaagctttgtggatatttccttagaaggctgtgttttctgtgcccactgatgcacataagcggaatgctctgcagcatactgcacggtctgggtaaagcaaagcaggtgctcttcgtcaatctgctcacctgtgcgataagagtcctgatgattatgcttctcgtaccccactatgggatagatgcatatctgtgggctatgcttgtgtcgcatgtgtttatgacacttgctgtcgggattctcacctgccacacagcacacaaataaaaaaagcctgcacatactccaggcataccggaatatgtgcagactcataaaactacagattatacacgtgaaaggtactcacctgttcttgtatcaatcttgataacatcatctgtctcaacaaaaagtggtacataaactgtagcaccagtctcaactgtagcaggctttgtagcacctgttgctgtatcgcccttgaagccaggctctgtctctgtaacagtaagctcaacgaaaagtggtggctcaactgcaaatacattgcccttgtgtgagcaaaccttacacatctcgttctcttttacgaacttgagagcatcgccaacctcatcctttggtaagtcaatctggtcatatgtctcaacatccatgaaatgatagaaatcatcatctgcataaagatactgcatatccttacggtcaatgtgtgctgtagggcatttctctgttggacggaatgtcttctcaacaacaccaccactgatgatattctttaactttgtacgtacaaatgctgcaccttttcctggtttaacatgctgaaattcgataatctgatagatgtttccctcgaactcgatagtaacaccgtttctgaaatctcctgctgaaatcattagttacttcctccttaaatcgtgcgagcctaagctctctcattcgtccattttacaataaaaaacaatacatttcaagtatttattttctattgcatgaatttgtattggttttatattagtttctagcctcgatatccgatatcatagctattctctttgcgtgtctgccgccctcaaactcggctgtcagataagcctttacgatatcctttgcaagctcaacacctacaatcctctcaccaaaggctatgatattggcattgttgtgctgttttacaaggcgtgctgtggctgtgtctgagcaaactgccgcacggattccgttgaccttgttggctgctattgagatacccacaccggtaccgcatatcagtattccgcagtcaaactcgcctgatgccactgcattagccaccttctcaccatactccgggtaattgcagctctcacttgaatctgtgccgaagttggtcacctcgtgacccatgctctcaacgtactccattattgtctttttaagctcaactgctgcgtgatcgtttccgattgcaatcttcataatatatatgcctccaaattttaaattattagttaaaaattatttatttactttctttaaatgcttcttgtagcaagcaattacaggcttttcaataaagcgcttaagcacaatctgtatctcctcatgcgggtcaataggtgctacaagtattgatctgatgcccgtaagattagctccgatgatatctgtaaatatctgatctcccacaaaaagagtgtttttcgtatctgtgccaagcctctccattgctgtacgatagcctgatggcttgggctttcctgccttgtatatatactttatcccaacctgcttagcaaagctcttcacacgcggctctttgttgtttgagagcacaaggcacgaaaaaccaagctccttaaggtgcttaaacaaagcaatcgcccgctcatcagcaggcgaaccatgagtcacaagggtgttgtcgatatcaaaaataatgcccctgtagccctccttatataatttatcaaaatctatgctgtatgtcgagtcaatgtactctcccgggtataaaaaactcatagtataaaattctctgtctccctgttaatctgttcattcaaggctgcctgctgcataacggtgacatccgcactgccaacaaaacgctgatactgctgcaataccttatccttgtctaaatcggatacagcctttgcgacatcaagtgtgctgatatcactgtcagcacccttaagctcatagctcgcattggaatcatatgtatttgcataatcaagcgaggtaaagctctgccttgcccttgcagcctcatgatcagccgtatcatcagcaatggattgctgtgaagctgtgtcatccactgcctgcttcgaactcataatctggctgtttctaagctcgtttacccttatggaattgtatgaataaaagccttcgctcgggcgaataccggaaatgttcatacgcaccttcccatcatgttttaaataaatcctgctgcctaaacactatttggtgtcaagcatctttttaagctctgtcataaatgtattgacatccttaaactctctgtaaaccgacgcaaacctcacatatgctaccgcatcaaggtcctttaatctgtccataatcagctctccgatgagtgatgtagggatttccttttcctctctggcaaagatttctatctcgacctcatctacaagctttgagattgtatctgctgaaatcggtctcttgtgacatgcaagaagcacgcccttttcaatcttggagcggtcatactgctctctgttgttatccttttttataacgatgagcgggattgtctccaccttctcatatgtagtgaaacgcttaccgcaatcatcgcacagccttctgcgcctgatagagctgttgtcatcagccggtcttgagtctattacccttgtgttgtcactactgcaaaatggacacttcatgctgtaccctccgtaggtatcatatagtatgaagaagcaaaatatctttgtttctcattataatacttcaaatcatcatctgtatttaaaaagacctatacatattttagtatatatatactaattttcgttgtcaatatgttttgtactgattttgacttttttataatttttttgtatttataaaatcataacagcttgcgccgcatatcagactcacatatatttaccaatattatatcgggtccaatcttcacaatcttaacccatggaatacaatattcataatccctgcaaaatattcccatatattttcccggtcccggcacgataatcgcacagattttgccacagaccgggtcaaactccaaatcccgtacgtgtccgatgaacctgccctcctccacgctcacaacctctttttcgcataaatccagaaaacgcataaaacagacctcccttggtctatcttatgcgtttctttttgattttgtgcttataaaagcgttttattcataaaattatacattaaatctgaaaagaattacatctccgtccttaacaacatactcttttccttccatgcctacaattcccttttctcttgcggctgcaaggcttccgttgtcgagaagatcctgatagttgactacctccgccttgatgaagccacgctcgaaatcagtatgtatcttgccggctgcctgtggtgcctttgtacctttctttatagtccatgcacggcactcatcctctcctgctgtgaggaaggaaatcagtccgagaagtgaatagctggctgctacaagcttatcgagaccgcttgactcaacacctaaatcctcaaggtactccttcttttcgtcctcatcgagatctgcaagctcctgctcaatctgtgcacagataacaaatacctctgcgccctcttcctttgccatttctcttacctttgcaacatgcggattacttgcgccgtcatctgcgaggtcgtcctctgatacgtttgctgcgtagatggtaggctttgctgtaaggagattatatcccttgaaccaaagctgtgcatcctcatcatcaggcacttcaaaggttctggccatctttccgtcctcaagatgagcctttactgcctcaacaagctcaagctcctttgcaagtgtcttgtccattcttgcctgctttgcaatctttgcaattcgcctgtcaagaatctcaacatccgagaaaataagctcaagattgattgtctcgatatctcttgcaggatctacagaaccatctacatggataatgtttgtatcctcaaagcagcgcactacgtgtacgattgcatctacctcacggatatttgcaaggaactggtttccaagtccctcacccttactggctcccttcacaagacctgcgatatcaacaaattcgattgttgcaggtgtaaccttctttgtgtgatagagctctccgagctttacgattctctcgtcaggcactgaaacaatacctacgtttgggtcgattgtagcaaaaggatagtttgctgaaagcgctcctgcctttgtgagtgagttgaataatgtagactttccgacgttcggaagtccgacgatgccgagtttcatggtatatatatctcctttaaattgatttcatatgtattttgtgtatcggatgtttgttgatacaactatgtagtgtaccacattgcaagagatttgtacataacctaatatgcaggaaggttttcacattttattattcacttaccatctcatcacacttaatctgctcgatatgtatggcaaggtagcctgtctcattgtccaaaaactcatgatttaagtcctttccaagctccttacatatatcacctgccagtgcgaatgactccggataatttttctcgataaactgattgagatcaacctttaatttttctccggtcgcggctcttgataccatgtggcggatatggttcatgaggcggttgtaggccatagtagtgacatctatgtgctttccaatcttttcctctataaatgtagcgcattttcgaactgctgccgccatctccatggcatccgatacctttgaattgtttaaggatgtatgaatatgaagagtaatgtagccaatctcatcatcaattatatcaatttgttttttatcctttagtatatggcgtatattctcagcaatcttgtactccttataaaacatcacacggatgtcatcgtttaaaggattgctgatctgttctccgttttccatacgctttacggcaaatgctatatgatctgccataggaaacaatatgctcctgtctatatgtccaaactcatgctctgcatcatcgagcagtgtgtttgcaatctcaagatactccggctcgatggattttactatgtcctttgccggacctctgtcccttgtctgggtcagctcatacagtgaatcctcatccgttggctcgacagactgtgtaattttctttccaaagcccacacccttgccgactatcagatattctcttgcgctcttgtcctttaccgcaagcactgtattgtgatttaagacctttgtgattctgtacatatcattccccccggcatttattatacccctgataatttatacaaacaattcaattatcatgaagtatgaattacttctcgtaggtgtcaactgcgtagagaggctctcctgccttaatcggtccatctgtgataaggcggattttctgattatcctttagttctgtgcaaatgacaggagtggtaactgatggtgcgtttgcttttaagtaatccagatcaagcttcataagcacgtcacccttgttcaccttctgtcctgcctcaacctttacgtcaaagcctttaccctcgagctttactgtatcgattcctacatggattatcataccaattcctgagtcggttgtaaatcccaaagcatgctttgtatcaaaaacgaataaaaccgttccatcctcaggtgctacaaccacgccctcctcaggtgtgactaccgctccgtctcccatcattttgctggcaaatgcctcatccggcgttgttgagaggtctgctgctattcctgtcatagggcttgatattatgactgtgcttgtcggctcttttacgtcgtcggcttcctgtgcttctttcacatcagattcctgtgctttatctgaagctgcattttcgttcttcacttcatctgcgcctgctgtattattttctgctacatcatcctcaaagtgttcctctgtcacactcgcaagataatcctccaaatctgattttatcactgttactcttggtccatagataatctgtacgccctgtcccttgtgcacgactcctgatgctcctgttgatttaagaagcgcatcgtttaccttttctgggtctattactgtgatacgaagccttgtcgcacagcagtccacatctgagatattggctttgccgccgagacctcgtgatatagtctgcgagagctcgtctacagccgctttgtcgtcagaagcttttgtatccttggcagcttttcttgcatttacatctgccttggtgtagagctttgtctctgtatcgtcatcctcacggcccggagtcttgaaatcaaacttctttataaggaagctgaaaataaagtaatacagtaagaaatatactattcccaccggaatcacgagcagccagcttgtcttttcatttccctgcaatataccaaacaggaagaaatcaagtaatcctcctgagaaagtaagtcctacagcgatgtttaaaatatgtgctatcatgtatgcgcttcctgcgagcactacctgtactgcaaagagagccggtgctacgaaaaggaatgagaactcaagaggctctgtgattcctgtaaacatacatgcaagtgttgcagaaagtaaaaggcttcctgcctgctttttcttttccggctttgcacatttatacattgcaagtgctgctcccggaagaccgaaaatcatgaaaataaactctcccgagaaatatcttgtggcatcggcactgaaatgtgcgatgtttgcagagtcagcaagctgtgcgaagaagatgttctgtccaccctcaaccatatgtcctgcaacctccatcgttccaccgactgctgtctgccagaacggcatgtaaaatacatggtgcagtccgaatggaataagtgctctctttatgataccaaagagaagagttccgaaatatcctgttcctgtcaccactccgccgagtgcatagattccgttctgcactgtcggccagataaaatacattaagattcctacaaaaagatataccactgttgatatgataggcacaaatcttgttccaccgaaaaatgacaatgcattcggcagctcaatcttgtagaaacgattgtgcagtgctgccactccaagtcctacgataattccgccaaacacgcccatctgcagcgactggataccacatactgatgtgatggttccatcaagcacatcctttgcaatgcttccgtctgcaaggatttttccggaaatcttgagcatcgcattgattgatacattcataacaaagtatgctatgactgctgaaagtgctgacacctctttttccttctttgccattccgattgctactccgaccgcaaaaatgagcggaaggttatcgaatatggcacttccgaccgcattcatgattacaagaagtgcatggagtatagtcttatctccgagcagccactgtaaaccataggtctcaattgttgtggtgttggtgaatgagcttcctagtcctaaaagcaagcctgctaccggaaggattgcgattggaagcatgaagcttcgtcctactctctgcaggacaccaaaaattttgtctttcatgagcttttcctcctataaatgcagggtatgtattgatttgcacctatcattcttttttgctccagcgacaaaaaggaggcacttatcatacactaaccctgttaaaagttatgtacgacaaatgcctccctaaaagtaacacgtctgttaaagtttatatcacagaagctttatcatttcaacacaattttcccaacgaatttattttttgttaatcatgctgtttttatacatgtttttttgtgaattatgtctaatgtcttttttctccagatgcctccatgtttccactatcataaagcattcttcccctgtgatgccctctgatgaatacacagccttttgtatgatgcgcatgtactcgtcccaatggattccgcaataatccggtccgcagtatttttccttcaggttagccagataaagctcatctgtcctgttctttgaaggatgtcccagtcctttgtagatgcggttgtttatcattattgctaccctgctgtaacggccttttttcaccctttttgcaagtcttgcttcccacaaaatatttcttcgccttttgatataaactatgatggctgtaagtgcagtcagaaaaatcacacagagtgaggtttttaaaatcaccggtggtatatgaagtctcgtttttgagttctgagcatctgtacgtttatccgcacctgactgtgaaccataagccttctcactgccatcacctgatgtactgtttgctgcagcttttgatgtatcatcttttgctgtgtcatcattttctgcatctgtattttttgtatcttcatttgcagcatcttcatctgccgcagtatcattcatatgctcactatcattataagcagcaccggtgtttgttttctttccgttgacaccaatatagtcaaactgattcacacctgtcacatactcaaaatatcccggtgtcatctccaccggaatccatccgaaatcatccagatatatttcaacccaggcatgcgactgcgaatccttcacctcacatatatcctcatcattttcaccggatttgaagctgtcctcctttgcacagtatccgcttacataacggcatggaacgcccatctgtctgagtatcatcgtgccagccgatgcaaaatgcacacaaaagccctgtctgctatttgagaggaaattatcaactacatccttaccgcctgttgaaggaggatttttgctgtacttaaaagccttcgatgtcagaaactgctgcaccagttgtgctgccgcaatcctgttggcatcattttctcttatatcgcctgtgtacatcatattgcttgtgagctgtcctgtcctaagaagcagcttcgcatcttttgcaacaattccgtcaccgccctgcttttcagtatagttttccattacataatcattgtatgccgcatagaaatcattgttgacctcaagaggctgctccggctcaaggatagacatttccagacaaccatcgaaaaagccgggacacgccgacacctcgatagtctttgtcgctttatcctttgtgataacaaagtcttcgtcaaaatctatatcacccttggcatctatactgtacgggtcgatacagtacggcaaataggtgtatttggtggaaagcttcttcatcgtgattgtatacttttcggtggccggattggtctcatcatcataataaccatcaagcagcgtggctaatccgattgtagtctgccaggctgccatccttgaagcatcatgatactctttttccatcccggaaaaatcagactttttaatccatctgccattttcatatgtatcaccgtagaagcttctcagataaatattagaaggcgctcctgcctttgcttctaccgtcatcactgttttttcactgtagcttggatagtgattactaaccgtgccatcctgtaaatcaatccccacgctgaagaatgattttacgctgccctccaaatccttttgaaaggcaagcatctgcggctttttatcggcaagtgtatcagcaagaggtttaaatgaaaatacacatatgaaaagtactgcagacaccgccgccatgtataaaaacgccgccgctatccttaaagcctcattgccctgtgcactgccatttgcatcatatcctgccactgtgcgtgcgttgccatctgcgataagacaccagagtgtacacagcgtgagcataacaacctcgctgacacttgggcttttgcctatgcacagctgtaccgcaagcataagcgttggaaataatgtgagcatgcgtcttcttttaatttgaaccgccagtgtcaccagcaaaagcataactataaacgatacaaagccaacaaatgccccgcaaaggctttatcgccctttggacagacaaatgaagtgccatagtacacatttatcagctcaagatacctgccctttacatacaaaaagccgtcttttatatgctctgcagcctgccagtttgcaataaacactccaagcagaaatacaagcagcatacctgtatttatcgcatggcgcacccattttcttgtgtcaagcgatgtaagcctgtttataaagccacttatcaccgaaaaaataaacagccacacatacacataatatgggcatctcacatgtgaaacggtcgtattcacaacagacactgcacacaccgtaagaagtactgctgcagctgcattggcaagttcagtaagcaggacaccaaacactgtaaatgcattattataatcaggctttatctcatttgtgtcagatctctgccatctgcttttcctaaatgacaatctcgtttttttcatccgctctgccaactatctcctctcccctttttatctgaagtcttccgtccacgctaagcagacacacaagcttttctgcccggtacttttcctcatacaaaaaaagcgcatcattctttgtatccggctttattttaagaaaactgttcaaaaatatgtaaaagccctcctcgtcatccactctggctctcacaatatcgtttatggcggtatcataccacgccacataatgagagcatttttgatccataagcgaaaaggaaagtgagacaagaagcttcataaaagcatccgcctgtctgcctttctttattccccttaaatctgctactatggccaccgcacatgcctttggcaggctgttttcctttaccatcagctcatcagtccttgcagaaagcttccagtgcacactctgcagcctgtcaccgttttgaaactctctgacatcaaacagttccgacggatcatatccgggtcttaaatcatcatagatatcagaatccccaaagaaatttcttactctgtccgttatcctcacaggaatctcatcaatctgcggcatcacctcaacatttgcatattttttaactcttttcgtgacataaaaaagcctcgaaaaatcatatagctttatccttacaagctcaaattcataattgccgcataggttcacgctgtacaaaaaatcactgcctcctgacagccattttgtacttttttcgccggataaattatttttcaccgttacacggtattttacaccatcgaagcctgcctccttcagtcgacaggaaagactcaccctgatactctcgccctgtgtggcgatagctatcggaatgtttatagctgccactgcccggtgcacctttacaagcaatgctataaatgtcagcaccataaacacacacataaagcagccaagcagtgccagtgcagcattaccgtatatcatcgacatataaaaaactacagctgcaataattattcctatcaaaaaactaatcacgattacctgcctttttcacataagttgtcggctgtttaacagcctttagtatctcatctatcactgaaagctctgatacatgtgatactctcgccttggtatttagcacgattctgtgctttgtcacatccgcaaatacagaaaccacatcagatggtatgacatagcttcgcccactcagatacgcatatgcctttgccatcctaacacacgcaatcgtacctctcggactcactccaagctcaatgtacggacttgtccttgtcgcatcaaccagatccacaatgtacgaataaatactgtcatgtataaacacctgttcaacctctccctgcatctcaacaagtccctgtgcattcataacaggctttatcgtatactcatcagccttcacacttttgccctttgcgatattcacctctgcatcatgtgaaggatatcccatgctcatacatatcataaacctatcaagctgtgactccggcaacagctgtgtaccggcgctgccctttggattttgagtggccatcactataaacggctccgggaccttcctgcttattccatccacagtgacatttccttcctccataacctccaggagcgcagactgtgttttgggacttgttctgttaatctcatctgccagaaacagattacacatcacggcaccctcgcggtacacaaactctccggtctgcttctgatacatcgaaaagccaagtatatcagcaggcagcacatccggagtgaactgtactctgtgattcacaagcgccatcgcccttgaaaaagctactgcaagcgtagtctttcccactcccggcacatcctcaagcagtatatgtccacctgccaaaaaggcagcaaatgccttgatgatacaatcatccttgccctttactgccttttttacttcgtctatcactaactgtgcattattcatttgtcttatcccccggttaatcattttaaactgccgatgatcatcttcatcatcttattcataaatagctatatatattttacatatttagtatcaatatttcaacttttatcacttaaattaaacaattcttaaaattaatcatctccgctgctacactgttccggtgatgacaagtgtgctctcacccggtgtgacaacccacgctcctgttgtgctatcctgtgtataggttgcagccggaacagtgattgcacctgccgtgctcgaaaatgtgcctgtcgcctcattgtaagtgtaatctgtagctgcagtccaggctgtgccgtttaatgcggctgtaagattgttcaaaaccggagcaaatgtgtctgttataaccacgcctgtggtattggttgccgcaacgcttccgtagttttgaatcctgaaggtataggtcagtgtaccgttttccgtcacaggaacagggcttactgacttagtaattgcaagatttggcgcagcctcggcatttactgtctctgctgctgtgaccggagtgattccggtgccactaactgtagcagtgtttgtgactgcagcctctatgccaagaggagcatactcatttaacgctgcctcatagatgacagttgcattgccacctgcagggacatttatgcctgttatgctaagaggcggtccctgtgttactgcaggcgctgcctggagtgtgccgtttgtatagtattttgcagtgttattcacataggttaatggtacaagagtgttggtgttaaaggtataagcacctagattgtcagaaagtgtcagaccgtttatcgcggtatttccggagtttacgatgctcaccacataggttattgtatcgttttgattgtaggtgtttttgactgctgttttcgtagcagaaagcacctccagtatttctccgactgctatatttgaattggctacattgttgccataacgaagctgtgcctgattagtaaatcgtgccatatattttccatcctttcatatattcaggtatggtttaatatatgacacaaatctacaaatgacacagattatttactgtcctgtttatttttctccacatcagcctttttgataagctccagaagcttttcaagctcctcctcatccacgccggtgtagcctgaaagctcactaaggctcggctcgaaacccttatcggattttagtttctccactgcacggtttaccaatgaaacctttcctaccacagtattctcgctctcatcctcaccggtctgctccctgatacactctttcatagactcctctatggcatccaaaagctctttttccacatctatctcatccccgcagccgcagagctcagtaaggcacatgaaaagtcccatgtttccctcctgtactacgtcctcaaagccctctgatgtaacggcaagcttctttgccatgacaagcacacttttgagccagaaatttgatatagtgtgtatcacactctcatcacctgcgagcagctttttgtacatatcgtcctgctcagcttttgtgtaatcaggtatctcttcaagctcctcaagatacatcctaaacataggtgaatccgggataaggctgtcctcgtctatatcaggctcagcttcattatcctgctcagccttattatttttcccacctgctatggcatccatcgaatcgccttctgagtaaattacattgttcaatgcagcattttcagacgattcatcctcatgtaattcgtcctcatgtgattcatcctcataatcgtctgcactctcattctcctgctcatgtggtgtgatgagaaattcaaataccatatcctcctgcgccttattaagctccatatccttaaaataagacatgatttcatctctgccaataggctccgctgatgtcctgataatctcggccacgctctgcactgtctctataaaggtattctgatctaacatattttacattctcctgtctgatttccaaaaaatacgtaactatatcaatccctggataaaaataaacaaaattaaaagcggcagtatgaactgaaaatacggcttaagcttccttgaaattttaagtcctgcgcctgtatttgcctcatctatatacttatcaaagccccagccccactttgtcacacaaaaaagcagataaaccagtgagccaatcgggagaagcagattgcttaccataaagtcctcgctgtcaagcacatccctgcctcctatgaggtgcagattgctccacacattgtatccaagtacacacggcatacttgcaataagtattatcacaccatttattagcgcagccttgtttctggaccagccaaacatatcaatggcaaacgacatgatattctcaaataccgcaataacggttgaaaagctggcaaaggtcataaacaagaagaaaagacagccccatatgcggcctccctgcatatttacaaacacatttggcaaagtgataaagataaggcttggtcctgcgtctacctccaccccatagctgaagcaagccgggaaaatgataaggcctgacattatagctacaaatgtatcaagagcacatattttggcaccctcacctgcaagagtgcagtcctttcccatatagctgccgaatatctccattgcggccacacccagactcagcgtaaaaaacgcctgattcatggctgctgttattacattctttattccaatttcagagaccgcatccagatttggaacaagatagaatttcactccttccaaagcccctgaaagtgtgatactgtgcaccgcaaggacaatgataagcaagagcagagcactcatcataaatttactgattttctcaagcccattctgcagaccacggctgcacaccaaaaagccaagcacaaccgtaactatcatccagaaagccatctgcttggggtctgcaagcatgtttccaaatgcagctgccgtgtcatcagtattcatgcctgatgtaaaatctccctttaggaatttaaagaaatacgcaaccatccagcctgagactgttgtgtaatacatcatgagcatgtagcagccaagcatggctatccatccgtgaatatgccatttactgccctctttctcaagagccttgtagctcatcacagcactttttctgctggctcggcctacagcaagctccatcgtaagcaccggaagtcccatgcataccagaaatataaggtaaaacagtacaaaaataccgccaccgttttgacctgtcacatacggaaaacgccatacattgcctatgcctatagcgcatcctgcacttaccagtataaatcccagacgtgatttaaatgattctcttttcatatttatatatctcctattgttattgcgttacgttatcaccctgctgtgagcattgactattgctttgtgctttattactctcctcaaagactcgcagctcctttattgcctgtccacccatcagatagagaatacctgtattgaatatagtcataaggccgattcctacatctccgagatcccagacaaatgtgtatgccgcgataccgcctacaaacagcataacaagagccagcaccttgtacatggtctgtgaaatccagttatccccaaacaggtacgcaacattactccttgcataaaaaagtataccaaggaaggtggaaaagctgaataaaaacaatgtgactgctataaaaataactccaaaatctccaagatgatacctcatagctgactgtaataaatccatgccctctttccctgccactatattctccggtgcagtgagcatgatcattgccgtacagctgcaaatcactatcgtatctataaatacaccgagcgcctgcgtcagtcctgcctttacaggagtatcgcactctgccgccgctgcagcgcatggagctgagcctgagcctgcctcatttgaaaaaagacctctctttacaccattcatgagcaccgctccaaagcctcccgcagccacctgcctgatgccgaaggcttcctcaaatatccttgaaaaaaccgatggcatcatgcctatatttttaattatgataaaaatggttatggcaaaatagcacaccgccatgataggaacaactatgtcaagcacctttaccgtagcatttttcctaagcacaatgatagcggccactgcaactaaaattacggtagtgtaaataggtggtatgccaaatgcattttcaaatgacgatgtaactgaattgcttataacctgacttatgccacaccagcagattagtccggatatagcaaacaaaacagctataataacatgttttttctttttgcctgatttatcctcaaagtaatggtgtatgtaatacgccggacctccacgatagcctgagtacagtggatccggctccttgtgaagctgtgccagtgtagcctccacaaaagccgtggatgaacctataatggctgttatccacatccagaaaaccgcacctgcgcctcccactgatatggcagccacaacaccaaccagattacccatgcccactctcgtcgccgtagagacaatgagtgtctggaacgtggacaggctgtctttatttttctttttacctgtcagcgcctttatcatgtccggaaacattctgattggtaaaagtcttgtccttacagtgaaataaattcctgtcggaatcaaaagaattatgagtagtgagattcccacgctcccaccgcctggcagtggaatgtgtatcagatctccccacaagaaagaataaactttttcaataagtgctactatcatagtaaatatcgtccccttagttttcattgcttcaacgcattgaagatgaagccagtattactactatacaatatgagcaggaaactttcaatatattctgtttttttgttctgttttttctttcacaaacagtaataaatacactataagtcccttgcatatgagattataatttcttataatgatatagttgaatattcaaaagatatacgcccggggagataaataatgataaaactaatagcaacagatatagacggaacacttgtaaaggacggctcactgctcatagatcctgagtacatgtctgtcatcgacaggctcatagacaaaggaataatatttgtagtctgttccggcagacagttttcaagcgaatttaagctgtttgctccgataaagcacaagcttttgtatataacagacggaggaacagtcgtgcgcactccaaaggaaatcctaaaaacatatcctatggacgaggatatatggaagggcatgtgccggatggtccgcgatgagctgcctgcatgcgattactttgctgctactcctgatttctgctttgcagaggatggtggcagcccggtctttcacctgcttcgtgattcatacggctttgagatgcgtgaggttgatgacatcacaaggcttgacagaaatgacatcatcaaattcactgtctttcatcccgacaaatgcgaagagctgtgtacaccggttttcattccggcatggaataaaaaagctcacctggcagccgccggcaaggaatgggtagactgcaacgcaaagggtgtcagcaaatggactgcactctcatacctaatagacagattcgacctgcttccggacgaggtatgctgtttcggtgacaatctgaatgatattgagatgcttcaaaatgccggtataagctacgccgtgtcaaatgcccgccaggaagttatcgcagccgcaaaacacacctgtgcgccttactgggaaaacggagtacttagtgttttaaagtcttttttataattttttaaatttttttaaaaaagtacttgcatttttgtaaaaccctgtgtataatatcatttgtccgtgtgacacagatattcacacagatgtttgcgcttctagctcatttggtagagcacctgactcttaatcagggtgtgcagggttcgagcccctggaggcgcattttttgtacccaaattaatttaccaacactttaaaagaagccggatttattccggcttcttttttttacatatctctgtttatatacatctgtttttactttttatttgttttatttatccaaagcagcttcaatcgcatcaatcacaatcttaagagccttgattctcgcatatttcttgtcgtttgactcaagcacatgccatggtgcgtaagtggtattggttttctttagcatctcatttacagcagtctcatacagatcccatttttctctgtttctccagtcctcatctgtaatcttccattgcttttccggagtattctggcgttcctcaaatcgagccagctgtgtatccttatcaatctgcacccagaactttatgatgacagcaccccagtctgacagctccttttcaaattcattaatctcattgtaagcacgctgccattcattctcgctgcaaaagccctctagtctttctaccataaccctgccataccatgtcctgtcaaaaatagctatatgcccggtcttaggaagacgattccaaaatctccacagatagtgtctggctttctcgtttggcagcggacttgcaatcggatgcacctcaaagcctctcggatccagcgcccctgtgattctctttatatttccaccctttcctgctgcatcccagccctcatatgctatgacaacaggaatctttcgcctgtatagcttgttatgcagctcgctaagcttagactgcagatttttgagctcctttttgtattcttcctcagatagttccttatcaagtgatatctcagaaagctttggaatcttctcaagtgggaacacattctgtaacagtggcacagcaagattactgtttttaagtgctgtctctattccactaaccagcgtctccagcacctgaagctcagcccattttctattctttgcatcaactatataccaaggatctgcaggcgaatttgtatcattcagatatctgtcaaacacatgcatacacttgtcataatgcttattctgccagtcttcatctccactgacacgccatctggtatccttattctcctttaatacctcaatacgctttttttgttccttccggctgatttggaagaaaaatttcataacaagataaccattgtcagtcagctgtcgctcgaagcgcttcacgctttcaattttcttcttgtactccttctctcctatcttgtcgtgcagtacgtcctttactacctcatccatccagcccgaatcaagaaactcaaacttcccctttgccggaatctttacaaaataccgatataaaaaaggcttacgtctttcctcctctgtcggctcgtccatggttgcgaccttgaaaaatcgcggatcaatattcttgattaccttaccgagcacactgccctttcctgcagtaccccagccctcaaacagcacaagtacaggcagtccatgctccttaatctgcatctgaagcacagacagcttagagcgtgctgcatgcaggcgctcatccagctcttcctcctccggaatttgtggtttaatccagttttctaacatgtaattacctcccaaatatataatttcagccataaaacctctacatcactatattagtatagcttttttcaggctaaaatacaatcttcacactatatttgtttcaggtatgtttcagttctccgcttctccaatatttgtcattttaaagccctctccgtgcacctcatgagactcaacaaccacaataaaagagtccgggtctgcatcttttacggatttacgcacctggtacatttccttactgttgcatgcacacattaccacctgaatatcgtcctgcttatatcctccctgcgccttaagaatagtgcttccgcgctgactgcattcatcaattacatcgcatatcctctttccattttttgtgacgataaaggctactttgcctgaattcatgccatatatcattttatcaataacaaccgcagacagtatattcactatcatgccgtaaatcattccgtcaatatcccgaaacaaaagtcctccaaccagaataattccgacatcagtaagaaaagagatgttgcccatcgataaatgaggccgcaatgcttttacagccatgatgataaaatcagctcctcctgttgaagaatttcttgtataaatcattgcatagcctattccgcaaaatacacctgtgcacaatgccgcaagcagtctgtcgccctgatacaccggaaacaacggcgcaacatagtcaacaataaaagaagacaaaagcatgcatcgtattgagctgacaaaaaattttctgcccaataatttgcagcatagtatcgcaaccggaatattaagcagaaccgttgataaaccaatggaaatattaaacagccggtataaaataatcgaaatacccgaaaaacctgtcatagggaactctgcctgcagggcgaagttatatatacctattgcataaaagatgcttcccgcaagctcccacataatctgtaccaataattcttttttcttattcatattgcatctatcctccaaaataaataagcgcccggaaacaaatcttacagtgtaaattactgcacctacgatttgctcccagacgctttaaccactcatccggtgaagagtgaacgttttctgatgtatgcaattattatatttgagatgttaaattaagtcaagccggaatcatcaattttccagatactacttcacaaggtatgacagcacatcacaaactgctgtagaaaccagtattgcaacatacactcattatttctgcataaattcaaacactgcctctttcgtcggaatcgcaggtattccacctcgcttttgcacacacaatcctgcaactgcatttcccaaaacagcacactttctgatttcttcccattccatcttttctacgggcttatttatagaaagaatactgcataatacgcctccccagaaagaatcccccgctccggttgtatcgactgcatgtgtctgaaatgctttgatgatttcttttctgctttttgttgccataagaacgccatgttctcccaatgtaatggcaaccagctttggtcccatagcaagaatttcttctgcagcctgctcataacttttagcccctgtcaggagaatactctcttcatccgatactttcatgacatctaccagttctacaacagacttcatttttttcactgcatactctttgctcttccaaagagacgggcgataatttggatcatatgaaataagtacacccgctgcttttgccatttttactgcctcgatcgttgcgctttctgccggctcgtctgtcagcgataatgatccaaaatgaaaaattctgcatccggaaattaatgtctgatccagttcttctttttttaactgtgtatctgcacccggttttcttgcaaaagaaaaatttctttctccattttcaccgatttccacaaatgccagtgttgtaaaataatccggatcttcgacgatagcatctgtattgattccttcagtttgcagtgtcctctttaaaaatttaccatgcatatcgtttccaacttttccaataaaagaggtgcgatacccaaaatgacttgcaactgtcagaagatttgccggagcaccgccgggattctgttcaaacagttttctcccaccctgactgtgtcctgcttccgtaaaatcaatcagtaattcccccaatgccacaatatcaactttttcttccatttttcagttcctccacaatctcgttataacgttttttatttaaccggtagaaaaataatacaaccgcagtcacaatccaaagtgcacctggaatcgtcgtaaatgcatgtttcataattgaaagtacagttgcattttgtgtctgatttgcaatataaccatattttccaagtaatcctgctaaaagtgctgttccaactgccattccgattttatttccaagtgaaataaatgcatactgaaaaccgtcatttctaagtccggttttccactccccatattccacacagtctggaataattgcatagattgcggtattaaatccagagaaaaaaaactgtgtgagaccagataatgcataaaaaaccgccggtgattctttggcattgaagaaaaacatagacaacatggaaattcctgtaaataaagcaaagagagatgctgttcttcctttgttattcaacttgcggaataatggttgaaaacaggctgcccctatgatagaaggaataatgatgcacatcgaataagttgtatagtaggaggcattcccttccacatatgtaaaataatacagaatatctgcgtttctaccatacaatgtaaatccaaataatatctgtcctgccaatgcaagaagatatggtctgttctgcataactgctttcaactgtatctttacagaaattttttctttttccggagtaatcactgcctctttcgtcttcgcaaagcagaagaaatgacaggctgcaaaaatacatccatatatgaccgcaaccgtcagatatcctgtctttgcactgtgactgccgaatttgctgagcagtggaactgtgataatatttaacacaccaattgcaatcatggctgcaaccgaacgtgatgtatttatttttgcacgttcatcaatatcctgtgtcatagcaccacacaaggttccatatggaatattcacacaggtataccccaaaaccagcagacaatacgtaattaccatataaatgatttttccattctgtggccagtcgggccttgcccagaatgtcataacaagaaggatcgctgtaattggtgccgctactaacagccatggacggtaccgtccccatttcgattttgttttatccgtaagtcccccgacaattggatcattgattgcatcccagaatcttgaaaaaagcataagcgctgacacagccgccatactgattccgaacacgtctgtataaaatatcatcagaaaattactgacgaacatccagctgaaattacatccaacatcgccaaacccatatgcaatcttactgatcagcggtacttttccatttttgttttcgctactcatatgtccctcctatttttatcagagtttctgacaaaactctattctttcctcatttggtcccttaatcataaaaaacttcacacccttttcccaaaatggcagttcttcgattccatctgtaataactgtgtatttttcattgcagattttctgatacatactttcaatgtcttccacatcaagtgctacatgttggtatgcaccgtctgacattgccgcctgcccattttcaaaagtttctatacagtaattttttatctgtaaaaatgccactttttcccctgctttttcattatatgtctgcataattacttcgaatccaagactcttataaaactcaactgttttctgtaaatcgtttgtcgggagcccgatatgggctactccgacaattccatatttattttccatacgaactccttacttttcattgacgttgataattactttcatcgttgtctcgcggttatcatcaatatactggtatgccttcagataatctttaaaagcaaatgtctttgagataagcggtttcaaatgaacttttccctcatttaccagtctgattccatctatgtaatcatcatggcggtacatcatcgtgcttttaatgtcaagttcgtgatcatttgccactgcaagatctacttctgccattcctgcaaaaacagccaccagtacgatcgtgcttccttttcttgcatatttaattgcctgtcccattgtgatattgtttccggcacagtcgtagatcacatctgccttatccggtccaaatgcttcgatcattgcctcaccgaagtctttatttttggtattcacacacacatcaattccacattcttttgcctttgccagtctaagatcactgatatctgtgatcattactttcgctgcacccattccaattgctgtctgtgccacgagatttccaatcggtcctgctccaaggactgcaatattcatgccagccacatcgcccatctgttttacaccatgaactgccacagcaagaggttcgatcatagctccttcttcataggacatttcttttggaataggtgttactttagatgcatccactgcaaaatactcagatgctgttcctgttgtctgaaatcccattacttttaattcctcacagagattatactttccatgacgacatggatagcaatgtccacaatatacctgaggctctatcgtcaccttctgtcccacatgaaactctgtgacattttttccaagttctgtaatctcacctgaaacctcatgtccttgtgttaccggatattttgtaaacggatgttttccatgataaacatgaatatctgatccacaaactccaatattcataatctttaccaaaacctgattttcctttacctccggaaccggaacctctctgaaaataatttctcccggatttgtcattacctgctgtaacataattgtttcctcctttttatgttgttttattttatgttttataaattgttttattaaagtaattacattattaccttgtaaacataatttgtcaatatgttttttcatttttctatatatttcataatttcaaaatctattttttgtgtatttttcacaattaacatgcaaaaaaaacggaaaggaaaccgtagttactgttttctttccgtttttttactataatatgatatgaggatcaaaaaatttacaattcacccatatgttttgtaaaaaagtatttcgctgctccaacagctgacgcttctttcttatacgaacaatttttcaagtatgaaacatcatgctcaaagccattatatgccatcactttttctcccagtggtatcatataatctgacaatacacctcccacatcacctcctagtataatatccatatcatatgccatccgcagatttgatatcaaaacagcaagatgatccagatactcattccatgtctgcaaaattttttcatcaccactttcaattttttccataaatgcatccagtgactgcctgttatcttgtgtcagtacacttgcagcacaatatgcatctgcacatcctgatttgccacaataacactttcttccaccgggaacgagtatcatgtgaccaaactcccctgctttctggttctgccctcgaaacagctttccatctatgcagaatgcacctcctaaggtgtggttcaaagacagatatatcgcatttggatacttttgttttttttctgcaagcattgcagcattagcatcgttttcaaaatataccggaatttccagagcctgttctaaaaagcgcagactataattctctatacctaaagcatgggattttaaaacgatccgttctttctgatcaataattcccggaatcgccactccaatcccaagcagcgtatccttcgctaattcgccttcaagaaaagttttgaccttttgtgccacctctgtacaataggataattctgccgtaaattttaagcggatgcgatctttttttataatctcatctccaagatttactaataccatttctatatgattcgctgtaatcaaaattcccattgcatgacagtatgacttattaatccctatactttttgccttccgtccaccggttgaagcatattccccagtttcttccaacacccctttttctaacaagtcattcacatttgctaatacagtcggcatactcaagtttaactcttttgcgattcccgccttggatgtaacatgattgtttagaacataattaattattttttttcttgttatattttttttatctttattttccgttttcttaccctcttttattaaatatattataaaagaattatatgcttttttattcttcttgtaaagtaatgttttataattaatctcctacagaataaaggaatatctgaaaaagggatttgcattagatgatgaccggttgaaaagacttggtggcagctatccctgataccttattctttctaccagcgtttcctttttcagattactgcttaaaacgcaggaaagtacaatctgcaacagaccgaccaaaaaaatcataataaaaattggcacgattggaacatgatagatattcattccaaatattccattatgttttgcataggaaaaaagtgcatagccgagcggcagaccaatgatcaaagctatgcatatggtaccaaccgtaaaaatcagtccctgtaactgcaggcataaatttaattgtttatttgtcatacccacagcctgtaatataccatattcctgcttttttgtcgtaatattcatgatcatggtattcgccatattcataaacccgatgagtcctacaatagccataagcagataacagccaagcttcatcatgctgcttgcaaattcggcagattgtaactgcgcatgataagtatccatttttatatacgaagtattagaaatcaaagtattcagactttgttctacagattttccagttctgcatgattttccgttttcagtaaatcatcaaatttattttcacggaatctgatcagaatttcttccaactggtctaaaattttctgatgacacgcatcttcttttttcttccaataaagtaaaaaggtcaaaagaagcacgcatatcaaagtgcttacaacaccgatcaccataacctgatgccggaattgcgaataaaatgcattccctttattcccccagtatccatattgctccaataatcgccttccctgttcgttagtttcaatatccttatccttaagcaattccgaaacagcatccagcccggaaaattcttcctttgcagcaatctctgtcataagattcattttatatttataatcttcataaaacacatacgtggtaaagcaatttaatattacaaacaataatataacaggtaatacccaggagagcactactgtaatcttcttgcgatatctctttgtcactgccttacctcctgattccatatatacccaagacctctgatattctttatatagaccggtgcagccggattgtcttcgattttctcacggagtcttctgatattgacagcgattgtattttcatccacaaaatccccttccagatcaaacacattttccaatatttgtgtttttgaaagaatctgtttcggattctgcagaaaaaaagtcagcattttcaactccgtttttgtcagactgatttcacgactctttatcagaactttcatttctcctgcgataaatacgatatctcccgaaatcatctttccggcttccgttttctcctgtctgcggcggaaatgtgcttctattttcaaaagaagtaccgaaagactaaacggctttgtaatataatcatctgcccctgcttcatatcccataacctgatccatctcctgatctagtgctgtaaggcaaataatgtatgtattataattgcatctcatccaccttacaaattccagcccattcccatccggaagattcacatcacaaatggtaacatccacattattatcacttgcaattcttttcgcttttttcactgattctgctgaaaaaacctcatatccggattttttcagtgagaatgtaattccacgatttaaattttcatcatcttcaaccacgagtatacctggcatagcatatgcacctctctttattaactattcatcttaaaatgcttcaatgtcggcattatgttcagccacatacttctttatcataatcaatggctgtcgcatacaagtcagtaatcttctgatagaactttctttcactggcacgaatttcacggatacgctctaactgcctatcaaaatacttctctgtcagatacgctccgcgtttcagccgttcatcatccatcacccagcctttgatggtgtagtccttggcgatctggtttacccatttacgaaactgtacggcacgctcggaattgaccttgaagcctacggcaatgatcatttgaaggctatagtgcttggtatcgcgtgtgacctggcgcgaaccttccgtttgaactattcggaaattccgaatagttgaatcttcctcaagctctgaatcagaataaatcttcttgatatgttcattgattgtacgaacatccacatcatacaatgtggccatcatcttctgtgtcagccatatattttcatcctcgtagcgcatctctatgctgtcctgctgatcacctacagaggcaacataggttaagtattccgccgcgctagagcggatagttatctcatcttttttctttttcaacttaatctcctcttattgctttctttttttatagtaatacctgctcatcctttgccactggaatatacacattatattatcctacaaattctctgtcaattctcgaaaaccctttatagctcatatgattcatttgcatatactgccacagatggcaaaaaatataatgtagattactataaccttgatgtcattatctccgtaggctaccgtgtgaaatcccaccgaggtacacagttccgtatctgggctatgggaatcataaaagaatacatgaaaaagggatttgcattagatgatgaccgactgaaaagacttggcagtggcaattactttgatgaattgcttgcccgtatcagagacatccgcttatcagaaaaagtattttggagaaaggttctggaaatctatgcaaccagcattgattatgatccccatgctgaaagctctgttcttcaaacaggttcaaaacacaaagaaccaatgtatatgaaagactggctggaaaccattgacgattatctgaaaatgacccgacgtgatattcttaccagtagcggtcgcatcagccataaacaggctatcgaaaaagctcatgcagaatatgataaatataagaatcgactggatgatacactctctccagtcgaaaaggattttattgaaaatatcggtatgttagaacaaattacagacagttcaaagaagtagtgattatgaagtggttgcccttgctgaattgtgaatatctcttgggtgttaaaaaggaaaaataagcagtgatctgaattataactcacagaccactgcttaaatttttattaaagcgataccctactccccatcttcactattttcaaatgacaacagcaacattttccccataactttccaccttcctaaatcttacttatgtaataattaaattattacataagtaagatttacagtcaactatttttccaaaattgacatttcaacaaatacagaatatactattcttattacaggcgtaagatttaaggagagatttacatgaagaatttaccacaaatttcggaagctgaatatgaagttatgaaaatcgtatggaaacatgctccaattaacaccaatgaaataacagaaaaattactgcagtccacaagctggagtcctaaaacgatacaaacacttattaaacgtcttgttactaaaggtgttctcacttatgaaaaacaaagtcgtgtttttgtttacacaccgttagtaaaagagtgtgaatatattagtcaagaaagtaattctttcttgaatcgctactataatggtgatattacctctatgctatctgcatacatagaaaatgacaaactgacagaaccagaaatagaaacgcttcgctctcttctatccaagagaggaaaaaaaggaggcgattaacatggctaatttcatgatacgctttttattatgcaatgtattgatcagcggtatcatcggaattcttttgatagccaaatgggtattcagaaacaacttgtccagccggatgcagtataatatgtggttgctgttactcggacttttagcagtaccttttatgcccttccgtctagttagtttcccgcaaattttctcatggctcagtagcgtacaaaactccaccacttctcatgccgatgttggtacaaataatgttatgaataccgatttatccggtactacaaattggatgaatgactttgccatttctgtaaaccatgacacatcatccgttaccgggtacattttattgagtatatggattgtgggaatgcttgtgatgatgatattggtaatcaaatcttctcttcgtttacgcactataaagagatctgcacttccccttcaaaatccgaaagttcgcagactgtataacagatgcttgaatgagatgaaaataataaggaatattcctgtgtacagtaccgcttttttgaaatcccctattatcgtaggatttttgaagccatgtatttatctgccaattcatttaatctcagattatcatgaatctgatatgagatatatgctattgcatgaactgcaacactacagacataaggatgccattgccaattatcttatgaactttgccggagtgctttattggtttaacccctttgtctggtttgcactaagagaaatgcgtaatgacagagaagttgcctgtgacacttctgttctaaaaatgcttgaagaggacgattatgaggattacggaaatacgctgatcaactttatagaaaaggtctccttttctccttttccttttgccgccaaccttagcggaaacatgaaacaaataaagcgtcgcattatcaacatcgcttcttatgagaaaccaacgttttacaagaagttaaaaggcatgactgcttttatactgaccacagttctaataatgggacttacaccttttatttctacatatgcagcggacgaaagtcgctaccaatggaaatcttcctcagaaaatatttcatatgtagatttttctaaatactttggaaaatacgaaggaagctttgttttatacgatcttagaaatgatgtctggagcatacatgatatagaacatgctacgctacgagttgcgccggattccacttacaagatatatgatgctttatttggattggaagaaggtgtcattacaccacaggattcttttattgcatggaatggagaaaactatccgtttgaagcatggaacgctgatcagaccttgcagtctgctatggcttcatctgtgaactggtacttccaatcagtggacgaacaacttggtactacttccgtttacgattatatcaaggaaatcggatatggaaataagaacatgagcggtgatttctccacctattggatggagtcttccttgaaaatttctccaatagagcaagtcgaacttttaacccagctgcagaataacaactttggatttgctcctgaaaacatcaatgcagtaaaagattccatctgcctttcttcttccgatgccggaacattctacggaaagaccggaaccggacgtgtggatggccaggatgtgaacggatggtttatcggttatatcgaaactgcagataatacatacttttttgctaccaacattggtgcagacagcgatgctaccggaggcaacgcaactgaaataaccatgtctatcttgtctgacatgaatatctggaaataaagaatcgggtaaaggtcaatctctgacttttacccgatttttcttaattcgctatctgaacaagccctttgtattcccatgtcgctccataatcagttgactgaaatacaatcccatctttctccgctgcatctgtggtaaccgttatcgtcaatgtgtcgtcctctttttcaggcatattcaggtaatcaaaatcctccaccgtaaatccgcaatcgatagcgatttgtggtaattctgaaacaagatccattggaagtttcatttcttcaaaggcccttccgccatcgcgagtgacatataagcgggaataggactgggatgcgcctgtaattcctgcaaccccaaagttctcatcataaaatattaaaccttctgcaactcccaattgtccactgaacggatcatcatttatgcattcccaagtagaaccaccatccattgtcttttccattacataaaatctgcttccggcagctgcatccgttatcaccaaacgccatccattattttcatctaaaaagaaatacatagttccatcactttgatccacagtccaactttctgtatctttagcatcctccacctgctgcatcgtattctcctgcttcaattcttgttgactgacgtactcaggctccataatatatcgaacaggtgtgacactatttaaatcaggaatatgcaaagatacctcaaacccaacgatttctccaccgcttctaagctgagtaaaattgccggttcctgtttcagttccatcaccatctgcatctcccgaaatatattgtaagccttcctctgaactaaaagatcttcgccccatatagagtatttcataaatctgctgctcttcaaatgtttcagcccacgcctctacctgactcgtccagtctgaattgttcaaaatttcaatcattggagacaaacgcatatcgtcactatattctccattcacattaccatctatccaaacagtcatatcattactgctgtctgcgtcataatcaataagatacgtttttttctctccagcctcattttttccatatatgaatgcataaatcctttgaatcgttccgttttcatcaaatgacacctgatatttatttgcaatatagagttcttccggcagttgcaatgcttcatccaaatccatcagaatcccttctacaccatcctcaaaaagattattatgctccagttctacttcttttttacgcatccactcatcaagtttccaagacagtgccccgtgatacggaactgcagaataaacgatacgtccaccaaagaataaagttgctgctataaggagtatcatttccgtatagaaaagtttcttatttccattatctcctgaattaacttcttgattatgccttttcgaaatcagccagagaaccactgtgccaaccaatcctattatacctaacgccaacatcggtatatgccttctcaagccaccatattgacatagatgccagaattgatacaacataaatatatatagtattaaacttacttttcccgtgattttataaatatatttcatgtaagtctcctttcttcatatctgtaaaaataccataaaacaccagtattatcaaatcattctttaatacggtattggtaatctggtatatgcataattccatcatcaaggattttattccccaaatattgaaagctaccatcatcagcaaactttaccgtaagttcatgggttatgaccgcatcctcacaaatgaccatatcacacaccgcatccaccgttaatgtcactgttccatcctcattttctttgatatcaataacctccggcagcgaagttccaaaaaaagttggtgcatagttaaggcagcctagtcgtacccatacgtaagtctgatttttttcatcaaataccgcatattcctgaatttgctctgctgttaccggaagatattccatgatcaaactctcaaattcttcttttggtattccatttgaataatcctcggcatcaaacgctttctgatgtttcatggcatacagatattcatacattccattatagtccagtttttccatatggtcagtatcccaattcgagcataaaagattatttccctgataccccagaccttgtacgcatctttctgacatttcccgttgttccttagataatggctttattcttaccagacagcttccgtcaacaatctctgtaacctccggtggttccggaacacataattcataacaaaaccatcctttatccgtatatttccactcctttatccttgcataagaaatatcggacaatccatatgtatcattggtgttccatgtagcacacgcacttattaaatacatgtcctttccatcaaaaataaatttatctctgccaatgccaccatctgactgcaactcgtaaagcactataaaaccagctttctcttcctgacagtttttaagaaaatcttcgacttttttataattttccattgctgcatatgctttcatcgttataaccggataccctttttcttttatccgatcctgcattttatagattgtcttatcatccagaaccgtattaactgcctcccctttatctgcctgagtataaatatcagaaataagctccagaatcattttacactcatcctctgcttcttttctttccggctcatctattggaaggtcataacctttttcccactgttctgcaacatcttcttttgcattctcgttttcttccgtagaatcaacatctctactatccatcaactgactatctgatgtcatatctttccttatgcatccacataacaggcaactgatcagtacaatgaaccaaatacgctttttcataaatattgtcctttccattcagtcacatttcccatatctcctctgctgatgatgttctcgcattcttttcataaaaaagttcctgtacttacaatcatcaccaatagaatcacaaaaatgattccaaacttttttacaaaccatttcatatcttccatcactgtcctccgtatatatcattccattcatcttcagttaaacgcggtgtatgccatgtaatgttgttattttcttcctctgaaacaatgtaatttgatacatactggaatcccccgtcagataatggtctgaccgtaacatcatgcatatatacatttgaatcgcctgcatacggatatatcacatgaacgttgagcgttatcgtcccatccgaatgttctttatacccaaccacctcggaatacggatattctggatactctatctcataaaatcctcttggtttatattcgtatgtttgagtttgataatcgtaaatagtttttttctgcaatttatcactgtcgatattaaaatattccataattacattttcaaactctgttttaggaatatgataaactgcacctatgcctaagttatcatctgctacatatggaaatttttcattatgcaactttggatacaacaaatcaaacatgtcatagaaattcagttctccaaaatcatcctcattccaatccactaaaaacatattatttaactcatatcccattggcaaaagatatttttcatttaattcccgacactttgcatccaatggcagtatacgaaatgctacatgctcttctgcagaacttaatgttaatacatacaattcttctgaaaaataagttccagaaaacatcagatatccatcatcggtatatctccaataatcggtttgatattcaccttcatcctcacttttcataatcccatctttgtatccgtaatagcatcttttcacatgaaccactcctttttctgtctgtaaatggtagaccgaaaatcctcccagactgctcacttggagtattgtcacttctgctttttcttgtttttccaccgaatcacaaaaatctatcacattttgtatttgtgtcatatcaactcgattttcacaatcaactgccgcatatccacattccccaaatctttctacaactttacgtactgtttccatatccttcagcttattttttgttgtggcttccgcataaatatctatcggaatatttataaaattgtcatccattcctttctcactgacaatttcaataggttcagaagatactggttcttctgtattccctttacatcccgaaatccccatcgaaaaacctatactaattaccagaaaaccacttttcaagaacctgactatcttttttgacaacataaccgcttccacctcttccttttacgtcttctaccatgttgacgatcataataggacgctccatattcttgtccgttgtaaaaacagaaaaccatcccaattcagtccccgttgtatcatcttttgatgctttgatttctgcagttcccgtttttccggctaatataatatccgttctatgtgctgcatagccagttccatgagaattatttatgacttctttcgtatcctccaaaacagtttgcgccacatcctttgtaaatgcttctttaatccagacatcaggcattgcatcttccttatatgtaagatatggttttatcatatttccttcattgcaaaatgcagaatacatacaagccatatgcaaaggattcacaagaatctgaccttgtccatagccactatcagccaactgtacctctttttcaattttttctgtattggaaaactgcgattttgccatcttaatatcaaacggaagtacatcattgaatcccagttttgttaatgaactttccatatcgtttttcccaatttttaatgccgcctttgcaaaataaatattatccgaataaattaaagcattttttagaataaccggctcataagcatgaagcgtcgttacataataagatccccatgaggaatctttctgccagctcaatccttcattcccataatcctcatctggatcaattgcccctgttgttaatccaatagcagctatgataggcttaaacgtagagcccggacaccatacctgtcgaaaacggttatacataggttttctttcatcttcattaagtgcagtccatttttcatttgacattcccataataaaatcattgttatcatatgacggtgtactgcttaacgccaacacttctcctgtatactgattcatagcaaccgtacaactcttatcatctttaaattgttcatataattctttctgcaaatccgaatctatcgttagttttatatcttttccattttctacaatcgtgcttactacgatttttttcttattgccgtttgaatcaacaatagaaatagcacacccattctgtccctttaattctttttcaaataacccttccattccactttttccaataacactgttcgatgtatatccctcccctgcgtgttcttctaaatcttctgctgtaacgttttgaacatatcccactaaatgtgcagcagcctcccccagtgggtattcccttacagtgatatctgaaattttcacacctggaatctctaataatttctcctgtctgtctttctctgccaatgtttcctgatctggctcaatcgacataagttttaattcattcacctttggaactgtttttaatggtacaaatgaatcatcttttacccattttgctgctaattttttttctatatcttctgttttcatttccaataattctgccaactggctgatagcatcattcttattctctaaatttccgggaactacgcctatagaagaagccactccctcgcctgcaagcaagtgaccatttcggtctataatctgccctctcttagcacttgttgtagacacttttactttatctgtggaatccagttctggaaatatcaaagaatcattccatatcagcttatatttgccttttttcagtataaatgatgccttattttcaaaagttacgtttcctgcaacagtatccatagatgtttcataacagatctctttttgttctttatcataagatgtgatatgaactttcatattatctacatcaattccctcataaatagcagaattacgttttacaaaatcttcctgactgatattcccagatattcctgcatcaatcatttcatacatttgttcatattctcgatttgaaatatgagtcatatacgttttaagaaccttctccggtgatacatcaggtacactttcataccatacaaacaaggcaaccacagctgtaatcaaacataaattcacgagccatataatgtatatcctgctttttttcttttttttcgtcatagcatctccttttcttacggttgtaagatttcaatttaaaaaaaattgttctttccatttcaaaagttatgtcaaagcaatcatgatttcttttttctgtatataatattcccttatatcttacatctgtaagatttaaacgtcaagtctttattttacttttattctaaataacaaaacatctggcacatactaaggaagtgccaaaaacaaccttagcaagcactgcctgtgtcatgacacaggcgaaattccctacactttcctatcgtatatgcgtgtgaatttccataggaaagtatccctaaccctcttttattttttcttcgattttcctgtggaataccttgacctttcctgccgcttttgctacaatctgctgttggtgattgcgcccaaaactgaataaaaacctgaaacgaactgttgtaaaaatcgaacattttacagcagtttttttgtacccaaaagagagaaaggaagtggcagaaatggcaaattgaaaccgcaccaatccggtgcaattttatctcatcaatgatgagcaatacatcctcaacaccaaattcaaagcatccggcatgaagagtatgtctgcgttcctgcgcaagctgatcttatatggatatgtgtatgatgttgattacagttacctgcaaaattataatacggagttgggacgtatcagctccaatttaaaccagattgcaaagagggtaaacagcaccggaaacatttctcaagaggatataaacgaagtaaaggagttgatgaatgaggtatggcatacacaaaaatccatgctataaaatgcagcggcttcaagctctccacattcgttaagcaagttgccattttcatcataaagcttataggtcatttgagtattacctaacgacgcttctccgtccaatccaagcaacaaagtatagtaattttcttttagtaccaaattcaatagatcatacaaatcatcttttgatataccttgttcagttattgcactgatttttttgccgacaactgatgaagaattaggattgaagtattcggctaaaatggttttcttttcttcgtagcataatttaacaaattgttctcctgtcatttttatactccccataccgtagtgtaaaatatatatttatatttcattctgtcggaactattatagcacatagatatgaaattttctaccgtctttcccccataatgggcgggccaaaaatgaaattttaaattccaccaccacatttggtggtggaatttactcccgcacagtaaaggtttactctttcatataaaaatgcggtacgtacggtgctgtgagaggacagcggttagccaccgcctcctactcgattttattatgtatttctggctctgtattcagaaggagaacatcctttttgtttatggaacaatcgactgaagtatagtggattattgtatccgacaatgcctgcaatctcgtttatagagtaggatgtcgtttcgagcaacacctgagcatttgtcatcctgagtgatgtgataaattgtattggtgtactacctgtgtattttttaaagcttcgaataaaccagcttatgctcataccaattgatgaagcatattcctccacgttaatagcgcggttgtagtttgtattgaaatatgtaatggctgtatccatctggctgtcaaggaattcatttctgattacatgctcagttgttattttacggttaaatataatcaaaaggtgtcgtagcaaaagcatgagcatttcctcataattgtcctgacatctttgaagctctgtaataatccttttgaaaacctgttcatattcaagagacgttccaacattaaagactcttttattgtctgtaaatccgtattttcttaaagtgttttttacgtcgcttccggtaaagtgaagccaatatatctgagtcttatccttaccataaaattcatatttttgaagctcttttgggcgaaataacactatatgtcctgctgtaatgattgtctcattttcaggattgtcaaagtggaaatgaacaagaccggatgatatgtatataatctggtaatccagtcttccccttggcctgtaagtaggcatcttaggatgctgtgacaggcgataggttccgcagcttcctacaatcagagggcggcttttatctttaaaatctttatgtgaatgattcaaatatcccgtgttaatatacattacacacctccattcgaattatagcattttatgcatgctttgtctatttgcatttatggacaaaatgtttagagcatgatattgtgtattgattacgtttcaaatggaattgagtcaaatagctgtgaaactgtagtgtttgaaaagtatcattttgtgcatattacagcctattatgtttatagacaaaatttgcacaaatatataaaattagtatagctgttaaagatataacaaagtaattaattggaggtttttcatggaagaaaagacgtacttaaagtggtacaacaaaattggttatggttccggtgatattgcaggaaatgtagtatatgcattcctgacatcctttgttatggtatatcttacagatactataggacttgcatcaggaatcgttggaacattaatcgcagcatcaaaattatttgatggttttacagatgttttctttgggtcacttattgataaaacacatacaaagcttggaaaagcaaggccatggatgatttatggctatataggttgtgctttgacacttgtagcagtttttgcaattcctacaagctggggcaggactgctcagtatgcatggttctttatagcatatacattattgaatggtgtattttatacagcaaataatattgcatattctgcacttacttcgctggtaacaaagaacagcaaagagcgtgtacagatgggctcttaccgttttatttttgccttttcaaccagtcttataattcagtctataacagttgcatttgttgatgtatgcggtggaggtgctgctgcatggagattcgtagctattatttatgctttgataggccttgtagtaaatacgatttcaggattgtcagttaaggagcttccggaagaggagcttaactcaggaatagagaacgatgaagaaaagaagtatggtcttgttcaggcatttaagctgcttgttaagaataagtactatatgatgatttgtggaacttatattttgcagcagttatacagtgctatgattggggcaggtatttattattgtacatgggttcttaagaataaaaatctgtttggtgtatttgcgtgggctgtaaatattcctcttataatagcacttattttcacaccaactcttgtcggaaagtggaaaggaatgtataagcttaataaacgtggatatattctggctacgatagcaagagcacttgtgattgtagcaggatacatgggaagcgttccactgatgatgctgtttactgcagttgcagcattaggacagggaccttggcagggagacatgaatgcagtaattgccgagtgctctgagtatacttacctgactcagggaaagagagtagatggaactatgtattcatgcacatcacttggaatcaaaattggtggtggaattggaacagctattgtaggatggctgcttgaaatcagtggttatgtaggtacaaatgcgactcagccggcatctgcaattactatgcttcaggtaatgtatttatggttaccatttgtatttgagattcttattacaattcttctttcaaagatgaatgtagaagctgcaaatgaaaagcttagaagagaaaaaggaattgaataattatcgtataatatgggagagatgatctgagtgcatttaacgtatgaaaacacaaatgaagagattattgcagtaaagcggaagccacggcaccagccaccacatctgcataatgcaatggaaattgtatgcgttacgaaaggaacattagagcttggtgtaggacaggagctgtatcacatggaaacaggtgatataggagtagtatttcctgatgttatacatcattatcaggtgttttcatcagaagtcaatgaggcggtttttattaatgctccacaaatgatttttggtagatttgaaaatgtactgaggaataatgctccacaatatcctgttgtaaaaagtgatgttattccggatgaagtgtacagagcagtggaatccataatagatactgggcagaatgatatatgggttgttcaagcttatttgcagattatactagcaagatgtattccgatgatgaaattggtggagaagagcaaaattggcagcgatgatataatataccgtaccgtatcatatatttctgccaattttaataagagtatatcacttgatggaatggcacatgaccttggcgtgagcaaattttcattatcaagattgttttcaaagacattccacagcagttttaatcaatatgtgaatgagacgcgtctggggtatgcctgtcagagaattgaaactacagatgataccctgacagaaatctcgatggacagtggttttggaagtcttagaacctttaatcgtgtttttaaagaaaaatatagattgacaccaagcgagtatagaaataaattacaaatttgactaaaaagctctctgtgcaatgcacaggagcttttttatatgcagacctctatttatttgtgctgtctgcatcaattacagactgaatctgcttcataagggcatcatagttgtccttgttatcaattccgccgagcattggttcgcctacaatattgccatttctgtcaacaagtatagttgttggaaacgccatgatttctgaggcatatttaccggcagcgctagaggagtcaattgacagattacgatatttgacaccctggctttcaagaacagaggcagcctctttgatagctgttttattgccatcgaaggtctcagtgttgatgccaacaacttctccgcccattgatttgatagcatcatttaattcgttaagcttggataactcagcgacacatggtttgcagccggtaaaccagaaattgacgactgttactgcattaccggaaaacaggctgtcatcaaccttattgccatcaaaatcctcaccggaaaaatcactgaatacagatgaggctttagagctgtccttcttgttatcgtctgatgatttatttttgttttcaagctctgctatctgttcctcgatttttcgtatggtttcaatatcctcattaagtgttttaagctcatcgtctgtgaatgaatccttgtttgattctacggtaccggcaagataatcagcataatttccgtttggatcggcgtcacttttgttcatcatgccgaatgccttgttccacacatcagcgtgatctgcaaaaagctgattttcctgctgatataaatcatcaagtcttgaatctgatttgccggatgcttctgtgccggcttcagtctgagtgttcttagaatctgtgttggaagcttgctttccaccgcatgctgtaagtgataatgctatgcagagtgtaaaaatagaaataaatgataatttgtttttcatgagtaatttctcctttaaaaataatagtaaaatgtttaatagttatctgttgtcatttttttgacatgattttcccataaaccggtagcagatggcgtccttcggacaggcctttatgcaggcaccgcagcgtatgcactcggggtgatccggtgtcttacacacatccacatccatcttacatgcctttgagcattgaccgcatccgacacatttgctgctatcaacggtgattttgagcaggctgaccttattaaataacgagtagattgctccaagcggacaaatccatttacagaagggcctgtaaaataagatacttagtacaatcactgcaattaaaatcatacatttgaaagaaaaaagctttcccagcgcagaacggatagcagcatttccaatagataacggtatagcaccctctaaaacaccctgaggacagatatatttgcagaagaacgggtctcccattcctatagagttcgttacaagcatcggaagaagtataacgaaaacaataagaatgacatattttaggtacctaagaggctttagtttggcggtggataatttctttccgggtattttgtgaagtaaatcctgaaaccatccaaatgggcacaaaaaaccacatataaatctgccgagagttacaccgagtaaaataaaaaatccggttatgtagtatgaaaatttaaattttgatgatccgacgactgcctgaaatgcccctattggacaggctcctgtcgcggcagggcaggagtagcagtttaatccgggtacacatactgtttttgcattgccctgatatattttacccttaaataaattcggaatatgaatattggtcagcagcgttgctgcggcctgtatccatccacgtatttttgccagcttttttgatagtaatttctttttcttatccaattccgacacactccagacatagttttattgctttaccaagcacggtagccgcctcacctctgactgcaccatagcttaccatggatacaccaaggataagcagaatgatttgacatgttttttggtatttcaacataatgttgctcctttttattgtattgttgaccagctgactttggtattatacaatataggttgtaaaattattgttaagaagcaggagaaaattttgagattattaattgttgaggatgagaaacaaatatgtgatatggttgcaaagagtctgtatgctgccggttatgaggtggatacctgttatgatgggaaagaggctcttgaatgtatactgtcggagaattatgatctgatagttttggatttgaatctgccggggatggatggcatggagcttcttaaggagcttagaaaatacaatgatgaaactaaggttttgatattatctgcaagaggtcagattgctgataaggtagagggactggatgcaggtgcaaatgattacatggaaaaaccattccatctgcaggagcttgaggcacgtatcagaagcctgacaagaaggaaatttgtacagaatgatatatgtcttaaatgcggagaaataaagtttgatacgattaaacgcgaggcatatgcaaagggagagccggttccactgacaagaaaagagaatggtattttggaatatttacttatcaatataggcagaccggtgagccaggaggagctgatagagcatgtgtgggatgccacggcagacagctttagcggagcaatcagggtacatatgtcttcacttagaaaaaagcttaaggcgaagctgggatatgatcccattttgaacaaggtaggtgaaggctataaaatacgggaggagtctgacagatgaaaagaatgtcgctacagtggagacttacgtgcattactacattgtgtattgctattatatgtggctgcctgactatgtttgtctataaaaatggtgtgcattacatcgattctctgcaggatgcggtagagtcacagggggatgaaaaaggaaataaatcagatgaaatatatatcagcataccggacgataagtgggatgagtttgcggatgaattttcggttcaggtgtacaataataaggccgactataaaagaaacagtctgataatcacggttttgctggcgcttttgggaggtgtcgttacttattttataagcgggcatgcactcagaccaatcaaggagttttcagataaaattgaagaggtacaggttcagaatctgtctgattcaagaatagaggaaaacaatgttaaggaactgaacaagctgggtatttcttataataatatgcttgagcgtctgtcggatgcatttgagatacagagacagtttactgcaaatgcagcacatgagctgcgaactccattagcgttaatgcaggtacagcttgatttatataattctgccactcaccctgggaatgatgcagacactttgcagaccataaaaatggttacggaacaaaatgataaattaaacaggatggtaaagactcttctagacatgagtgagcttcagtcggtgggaagggatgataaaattatattggatgctattgttgaagaggttttggcagaccttgagcctcttgccgtggaaaagaatataaagctgattggaaaatgtgaggatgccactatgataggcagtgatatccttatttacaggcttgtatacaatctggttgagaatgccatcaaatataatcatccgctcggacaggttacagtaaccgcatatcagagaaacaagcatgtttatctgtctgtagaagatacgggaagcggaataccaaaggagcttagggagagagtgttcgagccattcttccgtgtggataaatccagaagccgggagctgggtggcgtaggactcggacttgctcttgtccgtgaaatcgttagagtacatgatggcagtatttgtattaaatcaggcaagaccgggggaacgattttcgaggtgacttttgcgcagcattcaatgtagcgtttcattttacacatttgtcaacgctattaaaacagatttcttgtatcccgcaatatatgaaacagccgcttgacagtccggctttctgacttgagaaatagatttttaacggcaaaaatataataatttagattaaaatatactgatgtttttgccgataatgtggtatactatataatagattaacaaggttatttaatataatttatggcggaggataatagatgcgatatctttcagttgctgaaatagcaaaaaaatggaatatgtcagagcgcagtgttagaaattactgtgctaaggggcgtgtgaacggtgcatttcttacaggtaagacatggaaccttcctgaaaacgcagagaaaccggagcgcattaacaaaagaaaagaagaaccgattacgctgttggatattctgaaagagcaaaaggcaagtaaatattccggtggaatataccataagacacagattgatttgacatacaactccaaccatatggaaggaagccgtctgacacatgatcaaaccagatatatctttgaaaccaatactattggcgtagaaaaagaagtgctgaatgtggatgatgtgattgaaacggcaaatcactttcgttgtatcgacatgattattgatcatgcaaaagcagctttgacggagaaattcatcaaagaacttcacttggttttgaagaatggcaccagcgattccagaaaagattggtttgctgttggtgattataagaaacttccgaatgaagtcggtggcagggatacagcccttccggaagaagttgccgataaaatgaaggcattgctggcggaatacaatgccaaagaagaaaagaattttgaggatattctggactttcatgtgaagtttgaacggattcatccgttccaggacggaaacggtcgtgtgggcagattgactatgtttaaagagtgtctaaaatacaatattgttccgtttatcattgaggataatttgaaaatgttctattatcgtggattgaaggaatgggacaacgaaaaaggatatctgacagatacctgcctgaccgcgcaggacaagtataaagcgtatttggattatttcaggattaagtattaataaatgcttttaaaagttataataaggaaaaaggcaaaacaaaacttgaatattcacaaaaaatctggctgaaggatacattatatggaacattttgcaactatggcacaagttttgttttcatcgaaattctatattgtttcggtgtcatatgatagtgttctttgaagcacttataaaaatgtgttgtattcgtaaaatgcagttcctccataatttcggatatagaagcggttgtttcaagcaggagagcagccgcttttttcatacagaatgtctgactgtaatcgaaaaggcaggaatttgtatatttcttaactatagagtttaaataatttccactgtaatttaataattgttcaagttctgaacgtgtaatgcgtccatttgtgtcctctaagatgtgacttatatgtgtgaaaagaagaaaatcgttgtctgcttctacatggacgggcgtaaaatgaaagtgttctggattggacagataatcaaacaattctaaaagcattcctttgatgacataagtagaaccaagctttggaaacataatggcacgaagtatattgtcagttatggcatggagggtatggtgccagtctttgttgtttagcgatggcataaaatcaagatattcctttgtgtcaggattatcgagattatctgaaagaaatctaagaatagggttatggccgggtctttctatatccgggaaataaactttgggttcatcttctgaaagctgttggacaagctcttttgacattccgataaacaaaagagttgcatcggaagaaaaaatttctttgtgtactatattgtggttcataagacaacagcttccactgtggaacacaaaatcagtcttttcaatcagctgatggatttcgccatccaatacaataagaagctcgtaaaaatcatgaatatgtggaggtctcatattaaaatgatggatttccttttctgttttaaagctgtaaaatgtattttcacgtggtgaggtcatcaaaaaattcagatatttgtcatcgtttgctctattacatgtttcgagtgtgaactgtattggtgtaagtattttgatgtatgaattgattgtactgtttatattatcctgctctatgatgtttttgacagtatatgatgaggtcataatggtatatttttctccttatccacgaatatgataaaaactaactgatattttatcacatatgttatagaattgtaagcaataatttattaaagtaacagtatacaaaacataagcgtttatgaaaaatacaatacaaactattattgttaacaggaaaaaggaggttgcatttattatgcaggaaacagaaaagaaatacctgaaatggtatcagaagatagcgtatggagcaggagacctggcttcaaataccagctatggacttgtatcaagctttgtccttttatatttatctgatacaatggggcttaacacaggaattattggaactttaatgctggtatcgaaatttcttgatggaatttcagatgtgatatttggaaatttaatcgatcgcactaagtcaaagcttggaaaggcaagaccatggatgctgtatgcacagataggcgtatcactttgtctggtgctgttgttttcaattccgggtggaatgagtgaaactgcacaatatgcgtatttcttcgcattttatacagcactcaatgctatcttttatacagcaaacggaatagcatattcagcattatcagctcttattaccagaaacaagaatgaaagggttcagcttggatcaatacgtttcatgtttgcagttgtcacaaatattgtaatgggatttgcagtaacaggtgcagttgatgcctttggcggtggagcatcaggatggcgtatggttgctgttatatgtggtgtaatcggacttgttgtcaacacaataagctgcctgtgtgttaaggagttaccggaagaagatagtgtggcagttgaggatacacaaaaaccgaaggatgacaaaataggttttgttgagtctttgaagttacttataagtaacaaatactatattttaatcgtagcaatttatattgtttattatttcatgagtaatcttacaacaggctcagctatttattttatgaaacatgtacttggaaatggttcattacttggactgttctcaatgatgaagatgttccctgtaataattgcacttatttttactccgattcttgtaaagaagaccggaagcatgcaaaaggttaatttctggggatatgtaatcagtgatattttaggaatatttctaattatttttgcgatgcagaagaatttaccaatgatgttactttttatgttccttaaaggaacatttgccggaacaatgtcgggaacattaaatgccctgattgctgaaatcagcggatatacctatcgtacgaaaggggtacatattgatggaatgatgtttagctgttcatcacttggagtaaaagttggtggtggaattggtactgcggctgtaggctggctattgcatgcagcaggatatgccggaaaagctgcaactcagaccgcagcagctacaaatatgattttcagtatgtatatcacaatacctgtaattcttggtgtcgtaattactattcttcttggtttaatgaaggtggaaaaggaaaataagagaattgacatggaaagagcagaaaaagcagacaaacagattgaaagaggaatgaagtatgcagtgtcagaaatttaatgaggactggacatttgaaaaagctgatcaggctgacagattaaaagccttttacgggaacagtgatgcagttgctgttacactccctcacgatgcaatgattcgtgaaaaaagagataaggactgtccttccggagcacagagtggcttttatcccggaggtgtgtatacatacgaaaaagcttttatggctcaaaatgagtggaaaacgcaggatgtatttctggaatttgagggaatttatggaattgcaagagtctggataaatggagctcttgcggcagtgaatcgtaatggatatatggggttttcggttgacttaaagccatggataagctatgagcatgagaatattataagaatagatgtcgataacagtaaacagcctaacagcagatggtattcaggctcaggaatttacagagatgtcaatctgtggacaggaaaaggtgtatatatttcacatgataagctgcgtattacgacattgtcagtgaatgatgacatggcggttttagaggtgtgtgcacagttgaaaaacattattggacatggattagaggcagaatgtctgattgaaataaaaaaagatggacagaaagctgcatcgaatacacagagagtagtatttcgttcagagcaaatgcagacagtgcgtgtacaaataccgattgaacaaccaaagaaatggagtccggcacagccagctttatatgagtgtcatataacgacaaggtttgatgatgaaatatgtgatgaagcagtttctaattttggaatccgagtattggcgcttgatcctgtacatggattgcagataaatggtgagacagttaagcttcgaggaacctgtatacatcatgataatggcgtgataggtgctgagacatttaaggaggcagaatggtaccgttgcaagagattgaaggaagcgggttttaatgcaataagaagtgcacatcacccaatgagcagagcaatgcttgatgcgtgtgatcatattggaatgttggttatggatgagctgacggatatgtgggacaaggaaaaaaatacatatgatttctctgatatttttgaagatgaatataatcagtggattaatcatatggttgaaaaagactataatcatccatcagttgttatttattcagttggaaatgagatacaggaagctggaactaagcagggagcttggataaacagaatactatgcaataaatttcatgagctcgataataccagatatacaacgaatgcattgaatggattaaactgtgcaggcaggcgtcttggcgttattatgagggatgttgcagaaaaatttggaatggattcacatggaagtggaagcggtggaggaagcaatgcattaaacagttttatgagtctgatgtcgggcgaaaaaggagagttttttgcaaagcatccgcttgtttcagaagcacttgaagaatgttcgcaaagctgtgatataacaggactcaactatttaagcggaagatatgagctggagcatgaactgcatcctgcaaaaacggttctcggtactgaaacatatccggctgacatagaaaatctctggaagcttgttgaagcttatccacacgtggttggagactttacatggacaggatacgactatataggtgaagctggggtgggaatatttcattatgatggaaatgccaatttcacaagcatctatcctgagagactgggatatatcggagatattgatttgattggaaatcgaagaccaatcagctatttcagggaaatagtgtatggtctgacagataaaccatatattgcggtcgagagacttgaacacgcagggcagacagcatgtaaaacagcatggatgtttaaggataacatcagcagctggacatggaagggctttgaagggacaacggcaaatgtggatgtttattcatcaggtgatgaagtagagctttttctgaatgataaatcgcttggaagaaaaccggcaggaatagcaaatcattttacagcatcttatgaagtgccatatgaaccgggaactttaaaggcagttgcatatcagaaaaataggaaactgggtgaatatgagctttctacagcaaaatccgtaacaaagctaaaagtgtgtcgcgtaactgagaatgagagaaatatagcatatatcaagttatggcttgtagacgataatggtataattaatttacaggaagctgaaaaaagactgcttcatgccagtgttgcaggaaatggtgtgctggaaggatttggtacagctaatccttctagtgaggaagactatttttctgattcagtaacaacatttgatggaagtgctctggcagcagttcgatggaaggaggccgaatcaaaagagccggctgttcttaaagtgtggacggatgatggttgtcaggtgatgataaatatagaaaataattagatataaatggtgtatgcgatacttagtaagtattgcgtacactttttttgtgggaagcaaattaagctgtacaatacaaatattcatgagaagatagagataatctatggcattgcgattgttaaagagatgtaaatggtggtataattatgacatggattcaaaaagaaatggaaagatactgatggcaaagtcaaaagaaggtgctcagagtgggaatatttaagaaaaagccagttacaaaggcatatgataaagaaaataagaaaccggtaattaaagcaagcatatgtaatggcgaacaggttgcaggttttaaggacatccatacaggtaaaatagaagaggttatgctgattaaaaatcaggcggatcttgatacattcaagaaaatgtatggaatagatggcaatatagataaggaatattaaaaaatgtatttgataagctctgtaatagtaggcgatttacataatggaacgggtggtgaagctttatgactaaggatgaatggtacagacagttatttgagcgactggctaattcgaagttcagaagcagtttccatttgaagcagaaagatattgactacatcaatgaaaaaggactggatacaataagacaacatgcaaaggattttattgcaaagagagaagctccggcatatatagcaaatgatggtaagcagacaccaatgcgcggtcatccggtatttattgcccagcacgcaacggcaacatgctgcagggagtgcatacgaaaatggcataaaatgcagccgggcaaggaattaagtcaggtgcagcaggattatcttgtagatgtaatcatgacatggattcaaaaagaaatggatagaaaaatataacagcagtatttgccagccaggatgtagatacgcttaatgtatttaaaattgagcgtattgaggagtagaataaacaggggaaaggaaatataatggaacgtaatttttcatttgatgatgcaaaaaatcttatacatcgccataaaagacttcaggcaaggttaattgattttatgaatgctgacaagcgttacatggatatggtaagtgatatttcaggacattatattactactgaagtgattaaagaactgcgtaatattcctgttgaggaactaaatcgtgataagcttggcatcagagtcaagtcgctaagacagaatggatttagtacatacgaggatatctttgctgcatctgtatatcaattatctgctatcaagggaatcagtgatgacggagctaacaccataaaaaatatggttcgtgatacatattctgctgtaaaaaaatccaccaagctcaggctaagctctgataaccggactaaagaaacaacaaggcttgttacagctgtttctcaatatctcagagcaagacaagtggctgatttaagtacaaagctgtatgatgtgagcagcatgtatatatctaatgagataaacgatgttgagcctgcaacaactgtatttaaatggttgttttcttctaaagataaaaagaataaagctgttaatagctataattacctgcagcaaaagctaaatgatagttacggaaatgaagttaatcgtcttggcgaagaatataggaagctggattattattctgaaaatgatgtatgggctgattttcagaaagatccgattaagtatattaatactatcgagcagattgttccgggacttttaggaaatgatgacagtgtttatgggctgccggaggatctggccagagaagtacaggatgaatgtttcttcccggatggtctgctttgcagcttgagaagataccaggaatggggtgtgaaatatattcttcatcagggaagagtcctgcttggtgatgaaatgggacttggaaaaactattcaggccattgccgctatggtatctttacgcaataccggagctacgcattttgttgtgttgtgtcctgccagtgtaataatcaactggtgcagggaaatcggaaaatttagcaagctaagagcaataaaggtacatggttcgagcagattgtcagcccttgatgagtggattcgtatgggaggggttgctgttaccacatatgagactactgcttattttaaactgccggatgattttaagttttcaatgctcgtggttgatgaggctcattatattaagaacccagacgcaaaccgctcaattaacaccagagcaatatgcgcccatgctcaaagacttttgtttatgacaggtacggcattggaaaataatgtagatgagatggtaaatctgatagacattttaagaccggatattgcaaaacaaatatcgcgaatgaaaatgttatcgtcggctcctcagtttcgtgaaaaagtatcaacagtttattacagaagaaagagagaagatgttttaacagagcttcccgagcttcttgaaaatgaagagtggtgtcagttatgtgccgaagaagaacaggcatatgaagaagctgttttaagcagaaattataatgctgccagaagagtttcatggaatgtttcagatttgaaaaactcatgcaaggcaaatagaatgcttgagataattgaagatgcaaaatcagaagatagaaaaataatcgtattttcgttttatcttgatacgattaagaagatatcagatttactgggagagcagtgtatggaacctattaatggctctatttcaccatctaaaagacaggagattattgataaatttgataaggcacctgccggacaagttttagctgctcagattattgctggtggaaccgggcttaatattcaatcggccagtgtagttatactttgtgagccacagcttaagccttcgatagagaatcaggccatttccagagcatatcgtatgggacaggcacgaaatgttattgtatacagactattgtgtgataatacaatcgatgagaaaattacagatttgctttccgagaaacaggcagtatttgatgcgtttgcagataaatctgttgctgcagagaatgtcgagatagacactacatcattgagcgatattattcaggaagaaattgaacgtataaataataaagcagagaatatcgttgatgataaagaaataacacttaagtaaatgaaaggcagattggaatattacagatgaatacggcaccattcagagatttaggtaacataacagatagcgggaatgacaaaaagtgggattatcatgagcagatggcaaagtatcagatggatgattcagaaatcagccaaaaaaaggaaatgacaagactgctgatgaatgcgatggatgattacaatgccggaaaagtggctccggatactataggagcagattattttttccttaaccagttcatgacctatgaaatggagtatgactttgttgcgatagagatggactttttagagcattgcagggaaagacttgatgagtttaacaaagttggatggtatggtgatgaagagcatattaactatggaccggggctttcagtgaaaaagaggataatgcgcctgatatacaatggagctaagcttagggatgaggattgtcttgcactgattaagtacctttataagctgtaccacaagaaggagtacaacagaatcaagagattcagcaggatttcagcaagagaaattttggatgtggtgaatgacaatgaagatggttcactggattcagctatcggtcgtgtactcggcatgtgccatttcatgaatataaaagagaatgaaatgtgtattatactataccatgctctgaatgaacaccgaataacctggcttcaatacatagatgatgatgacattggcattgacgtactgaatctggacaaggagctgattaaggaatgttcggcccagatagacaaatggtataatgactgcttttgggatgacaaacacaggaacggtctggaggcatatttcgaggtggatgattttgtggaaatgtgcctgcagaggagcggttataagagtgactatgcatatctttgcaatgaaataggctatagtgcaaaaactgagatgcgagatgcacttatgctgcttaagactcgtaatcctgaaagagaatatacatatgaggaagtgcagcattatgcggcagtgtataatttggtagaggcgctcaccgatgcagcggacgttcttgaggagcaggtggcatatctcacaggcgagaacccggcagaagacatgattaatgatgctttatttgacgcaaaaaacattgtcctgcacgggcagacaaagaaaaagcatggggagcagaatgtaatcacaaatattgctcctgtaagcaccggagatgtgtgtagtgaagaatacctgaaggagatagctgatctgcgcagaaaactaaacgaaaaagagcaggagaataaggcgctagtccaacaagtgccgccagcttaaaaaagaacagttacagtcagagagccttatttcaaagtatgaatcagaacgggatgagctgatagccctgagaaattttgtatacaggcttgaaaacagcactttggatgatgatacagaagacatcagtctggatgaaatgaaggatgagcttgttgaaaagcacatagttattattggaggacatgtcacctgggtaaataaacttaagaagctatttccggaatggaagtatattgacaccaatgcatacaagactgttgatggcaaaatgcttgacggaaaggacatggtatatttcttcacggactacatgaatcatatcagctacacaaagtttatagcggctgtcagagaactgaagataccatttgggtatctggcaggcacgaatatcgaaaatacggtaagacagatatatgatagtgctctttgaagcacttataaaattgcattataataatggtgcagaaggatttttttgtggatgttatcatgacatggatttaaaaagaaatggagagcttttatgaaaaaaattaaaaaatgtggatttgttttgattgtttgcttagtttccgtgattatagttggagtttattttataaatcaaaactggacaattagatatgcttctgtatttgacggatttttcggaaagggcaattggaagtgtattgatgaagagaaaaaggatagccttatttacgatgaatatgaaataaacaatatctatccggagctgtcagagaatgttccgggaaaattccataattggtatattttgtatgatgatggtcaaaataaatcaatctggcatatcacagatcatgtttataaaataaacaatgataagtatagcattatcaatcataatcgattatcggctaagcaggcattgacaatggaattgatggacatttcatttgacgtaataggggacaatataaaaagtgacattatagaagaatatcttcctcaagctgaatcggattgtatagaagtcggcatatcctacgagggtggtaatcccaagcctgaattttatgataaactgttgaaagaaagctggttcaaatgcaacgaagtctctgcagaacattacctgtcaatggacactgctgatttttatatagatatcaaagcatatgattatcggataaaaaagctttcagatacagaaaaagatcatttaatgaacagtttggaaacgattgaacagggattgcgtgataaatatggagaacatgcttcatataaaatttactttgacgattttcatcaggcagagcacaaggcacaatgatatttattacattttttatttagggctggcaatggcatcagcgggaattatttttacaagaaattatttattttacagtcagttgattgagaagagagatggattaaaaaagggataattctaattgcaagaaaaagtggtttgtaatataatgagaaaagcaatttttactttattttgacaaatataacatgtctatacaaggaaggagggtgtgatatttgtatttagaaaagatttatatagagaattataaagcaattgaaaaaatggatatagacttaaaaccaggagtgaatctgattattggcgataatggagcaggaaaaacgtctgtccttgaggggattgcggtagctcttggaggtttgtttgtcaacgtagcaggtgttagtactaagaatattgtaaaagatgatgtacgtatgagtataaagcctataggggattcttcaacagcgattgaatactatgaacctgtattagccggctgtacacttcatataacggaagaacagaattttacgtggaacagaatcaaggaagaagtatctgccacccataccaagattgacgataagaatgtgtgtgtatggatgaaaaagcttacaaataattcagattctgttttgccattgattagttttcaaagtgctgccagagcatggagagtaagaagaggagactttggaaacgagctaaagaagaaaatagacgatagacgatgtgggtatatcggatgccttgattcttctatggatgtaaaatctattcagcagtggtgtctaaaacaggaagtggtgcgctcaaataaaggaacagtgcgcgaatatgaaatgtttaagaatattgtggcttcgtttatgaaagaaattaatgaactgaacgaggcaccttcaatttactattctctgcagtttacagagctggtttacaagaatgataagacagagatgcctatttcaaagctgagtgccggctatcagtctctattgtggatggttatggatctggcgtatcgggtatgtatgcttaatccggaattagaaagtagagaacagattacgggtattgtgcttatagatgaaattgatttacatcttcatccaaaatggcagtggaatgtaattgacgcattgcaaaaaacatttgcaggtgttcaatttatcattgcaacccattctccaattgttatatctgcatcaaaacaagcaaatctgattctgttggatgattcacaggatataagctatctaccggattgttatggatatgaagtggaggatgtactgcgttatcgtcaggagagtgtatcaagaccaaagaaggtgaaaatgcttgtcgatgagatagagaatgcaatcgatgatattgaatttgataaagctgatgctgcattggaaagattaaaaaatgtgctgggtgaagataattcagagtacaagaagatggcaggatgtatttcagatgcgaagtttatagaggagtgctgatatgctgtatatagaaaaagaaggtttgccaaatgatataaacagtaagatcatagagttgagcaaaagtgagaaatggaaaagcattagcgaagacgacactacagcaatccgcaacgccttcgacaatgattttcctaagaatgaagtgaaagagattttacttcatgaacagcatggaatctgtgcttattgtatgagacgtatccgtatggataatcattccagagtggagcatcttgtaccattgagcaaaaacaaggacatggcaattgattataacaatatgcttggagtatgcgatggtggtgagaaagtaaccgggaatcaagggcatatactttgctgtgatgcacataagaaagagactgagatcatgattagtcctcttaataaggtacagatgaataagatcgcatacgattctgaaggcaaaatctatacgaaaccgaaagatgaagatatggaaagggatataaatgaagttctcttgttgaatggtattcagaaaaaggatggtacggtaagagatacatctacagaactgttaaagggcagaaaagacgcctatgacagagcaaagaaaatgatggctgccttgaatataaaaggaaaatgtacatcagcaacgcttaaaaagataatggatgaactatacaacagagaagaaagagatgagtttgtaggtgttcagctctattatttcaaaaagcattacaattcgttgattcgcagaggtatgtagtatctgatttaggaataacagtagtgattattgaacactatcggacactttttacttattacagggcaaatcaaattcggtatgaagcggtttgatttgccctcgttttttacttcgatattgcagagtgtcactctacagacacgcagtatgaacaagtctataattccttgattttttcattcatttttctggcatcattgcgatagtgaagcatgaagcctccccaaattataaatgccaaagctatttgaaatatggctgcaataattccgtgaaggatagaacttgttcctcctatccatccgacagtatatgcgacgattgtataaataatacagcctgttcccatgtgaataattattttaaaaggcattggaagattgtctttttgataaatcatggccggaagtccaaaacccagacctacaattatgcacccgataaccatttttgaaaattggtaattatctaaactgaaattaccgtcataggcgatgtcaaataccattcctgtaatgcagaaaatggttaatgctataccaatgctggttatagtgtttttaatcaaatttttcatagtttctctcatttttgtcctcctataatcccagatattttttaaactcaggcagatattttcttgatacgtaatccttacatccgttttttagtttcaaaagaagagtgccgctaaaaccagcctcgacattgctcatataagacagattgaccaaagttgattttgaaatttgcataaatccggcaccaagctgctgttgcatttcgtacagtctttttcgggaacggtagcggtgttctttgccataaataatagtatctttgttttctacccttaccatgtatatttcttttggctgtaaaatgacaatatcattttcgtttttaaaagctgtaatggggctttcatttgaaccgaatatatcaagggtacgctggatgctgtcagtgattttatctgcatatatgatggcatatggttcgctgtattcaggggaaagttcaatacttactttcatgtaaaatcctcctttctttttggtgagttaatcatacaatatttcatatataatgtctcgcatttggatgtaagtgacgaaaaaacatgtgtaagatgcgttaaaggaggataatcctgataagttccgctatcggaagatatgtgagtctgcacaccgtacggcacaatcaacatttgacatgttggaagttttagtgattaatatttctttaattttgtcagcatactatttacatagtacaaatagtaatgtactttaaaaaagtacaggacagtacaaataatcagaaagagatatgataaccatgaagaagaaattaattgcaataatagttggaatgatgctttgtgcagagctgttgggcggttgtggtaataaaaatataaacaaggataatattaccacggatactgccgaggagtcgaaacagcaggattcgaataaaaaacaggagctgccaactgcaacatatatgggtggaagcaataccattactgaggtgtgcgatgagcttggttcagccggggcatcgcatgtagatacctttaaagaatgggtgaccgattttgcggattctgccgggaagaatgcaaagcttgaggatacatggtcagatgcatataaaatgaaagcagatactgttaaatgtatggatggctgggagaaaaagcatgactattcagatgcagattgcagaatgacagcttttcttttgctggatgggctgcttcacgcacagtcaacggaagatagctatagtggcacatatttaatgtttgatacggaagcaatagataatgtagacaggtatgaaatcataaggcagaataaagacatgtttactacattatacggagaaaagagcattacggatgataaacatcctgaaaaaacattctctgacaactggaaaaagtatggatttcaaatagacagtaatcgtatttcacttattagtatagcaatatatgatccggattctgatgctatgttcgtgggacatacaggtgtattgataaagtacagtgactattatttgtttgtagaaaaaatagcatttgagcagccatatcaggcaacaaaggtgaataatatggatgaactattaagtattctttcactaagacctgagtatttcggagaagagaaagaggctggaccatttgtatataataatggagactatgttggaacattagaattgcaaagtgcagagttgtaataatgaaaattcaaaatcgccttttccgttgacataacttataatacactatataattttttataaaaatcctcataaggataaatcggaaaatgaagttaaagaataaaaaaagcagaaatataataggtattatacaaagctgtcttatctttgcattggttattcttgttatttttatgatgatacagattaaccggctgcaaggaacggcaagggtaataaattacgcaggtctggtacgtggagcaacacagcgtgaagtaaaattggagattacaggatccccaaatgatgagctgattaaatatttggatgatattttaagcggattaaaatatcaggacggaaattatgatctggtaaagcttcgggacaaggaatatcaggacaaattgcaggttcagattgattactggaataaaataaaaaaagaaattgaagctgtaagaagcagcggatatgaaaatacagatattgtcaatatgagtgagaattattttaagctggctgatgatactgtgtcagcagcggaaaattattcagaaaaggttgctacaaagattcgcacgatagaggttttttcggcactggatatgctgtgtcttgtgatattgattatagtacagaccataatggcaatgaagatggcaaggcaaaataaactgctggagcaaagagcatatactgatgcccgtacaggattgcctaatagaagtgcctgtaaagaaattctgaacaataatgagataatcagttcacctacggcatgcattatttttgacttaaataacctgaagtttattaatgatacaatgggacattcggcaggagaccggctgatagtaaagtttgccggacttttgcgcagcgtatttcctgaaaaagtttttgtgggaagatatggcggcgatgaattcatggcagtcatctatgacacagataaagcggaggttgatgaaatcctgaaatgcttatgtctggaaaaagataaattaaacaacaccggaaatgaactgcaaattgattacgcttgcggatgggcgatatcggaggattgtaaggagagtacattacaaatattatttgatagtgctgattcttatatgtatgaaaataaacagttatgtaagaagcaaaatcaatgagtaaaagcagataccataattaccgttgatgcagtatacttatccttaccggtccgttattgtgctttatcaggtgtctgtatatcacaatcactgcgattatgaagcagccaatctggattgaggctgtttttatagtcaaaaggacattgaatgcaaaaaaaccaaatgtcagaatagatctgagcgaatgtggatttattattactacaactgaaaagaatataaagaaaaatgccaaatagacagctggatgcaattccggaaacaggcccaaaaggactccgaaggaggcggtaatagctttaccgcctttttgtttttgtaaaaaaggaaatgcatgtccaaagacaggtgcaactaaaacaggtacaaacagaagtgagtttatatctaagcatttctgaccaagatacaccgggataaatccttttgcaagctcacatatgagtgagagtattccgcataaaaagccaccatacataaatgcgttgctcacacccggattgtggtcatcgggaagtgtgcagatatcaatgttttttaatagttttggtatccagtaagcaaagagagtgcttccgagtacgaagcctaagagtgtaaataaaaaatatagcatgataatttccttatagttttatagttacatggttttatagtcagtcagttgtatcagtgtgagtcagtttttcaagcagaccaacaatctggatggcagcatagggctttcgctcacggcgctgtgcacgtatcatttctgcatttagctctttattttctatcattattttcccaagctcaatctgctttgacagacgatttgatgagacagacagatgacgttttttgaaaaatgcaacatttgctgcctcgcatccggggattggagcagtgtgtacaatcggtatattttttaccagtgcctcagttgatgtgaggccgcctggctttgtatagattacatcacaggcatccatgaaaagtgaaacctgattggtgtagcctattacgtgtacacgtttgttgaacttaaactcattttgcagtatgcgttttattttagtattgttgccgcaaatgattacaatatgctcattattatggcatcttattgcaagctctgcggcaaagacagcaagcttgccaaaacccatgctgccactcatcacaagaaagataggcacatcggatggcagatgtaatcttgttcttgcagcagctttagcagtccttgtacagaaggcctgtcgtaccgggatgcctaatggcagcagcttgttttcaggaataccacgttttgcaaattcatcggtcagatcatcgtgtggaataacataataatccatatttgtctcttcccagaatgggatacaggtgtagtcggttcccacagcaacggcagggatatgaagcagattttttcgcttcatgcagctcagggtttcagcagggtacagatgaggtgtgacgacagcatcaaagccgtttgattcaatgtatgctgatagctttttacaaagcagggcattggcaaaatagacaggggatttacgtttatcactcgatatcagcatgccaaccttatagagtagtccgaagaaaaacggaatatgctttacaatgcctatatatgctcctgatactgcgtgcgatgttcctttacccgataagagaaacatatctatcattgtcacagaatgtcctttatgctctgccgcttcttttatagctttaccggcactgttgtgtccctcgccggtgtcacaggataaaataagaattttcaaaccgtttagttccctcctaaataaaatatgcgataagtgtaccataattttttaaaataatctacagtgcaataaaaggttgacatatctaagttcaaagcttattgtggtagctggaatgtacaaaatagtataattataaactacagattactgatatgacggaggcttaatttgagatggaaaatttaatgttttgtctaaatgccacaggacctatttttctgatgatggtgtttggactttttcttcgcaaggtggggattttggacgaagactttgcaaacaggatgaataagtttgtgtttaagatacctttaccttttttactgtttagtgatcttgcggcagttgatttttcaagggtttggaacattaaatttatagtattctgctttgtggttacgttgataagcattacaatctcaactctcatatcatgtctgtggagggataaatccatacggggcgagtttatacaggcctcatacagaagcagtgcggcactgcttggaatagcttttatccagaatatctatggaaatgcaggcatggcacccgtcatgattataggaagcgtaccgctttacaacgtgatggctgttatagtgctttcatttttcaagccggggcaaaacggcatagacagggcagtgctcaaaaagacatttaagggaatagtgacaaatcctattattttaggaattgttgcaggacttctgtggtcagctattggtctgccgtttgcgggaataccggcaaaggcagtgacaagcattggcaatatggcaacgcctatgggacttatggctatgggtgccacatttgatttgaaaaaagcatcagcaaaggcgaagcctgcatttgcagccacatttatcaagcttgtaggctttgtggcagtatttcttcctattgcggtagccttcgggttcagggacagtgagcttattgcaattcttgtgatgcttggctcagctactacagtaagctgctttgtgatggcaaggaacatggggcatgagggcgttatttcatcgaccacgataatgctcacgacactgctcagtgcgtttacactgacactttggctttatataattaaaagtctggggcttgtataaaatggaagaacataactgttgatttggtggataattcctctttactttagcgtgataatttgctaatatgttaaaaggttgtagttattggatgattttgaataattacaatgattatttaacatatggaggaaatgagcatgagaagaggattagcacttcttttgacagcaactttagcactttcaatgactgcctgtggtggcagcaagggtgcaggaacacaaaaaagcgaaaagggcgacggcatgacctacgcagttgaggcaggctcagcaggagaggctgtggcaaaggaaaagggctttaattacaattcggtttcatcacaggctgatgcgcttatggaggttaaatcaggtacatctgatgcggcaatcatagaccttttaatggcaggagccatgattggagagggcacaagctaccctgatttagtacatacaacagagcttacatcagagaagtatggtgtcggatgccgtaagggttctgatcttgcttcatatatcaacagtgtattcgcagattcatatgctgatggcagcgcgcaggagattgcaaagaaatacggagtacaggattcacttcttgagcaggagccttgcgagttcaagcagtctgacagcgacagtgatgtggattatatcaagtcacagggcaagatgattgtcggtatcacagagtttgagcctatggattacaaggataaggatgacaaatggattggctttgatgcagatatggctagacttgtcggtgagaagctcggcgtggatgttgaatttgtagttatcgactgggacaacaaggttatggagcttgattcaaagaagattgacgttgtctggaatggcatgacactcacagatgaggttacaaagtctatggaatgcacaaatgcatactgtaacaatgcacaggtagttgttgagcgggagaaataaaatgttctggaatgttacacaagcactaatgagtggtctgtggaccacctttgaaatatttatactgacacttatattttcactgccactggggcttgtatttgcatttgggcttttgagcaggtttaagcctgtcaaggctgtcatgaatgtgtttgtatgggttatccgcggcacaccgcttatgcttcagcttatcattatattctacggaccgggcttgtggcttcatcaggctatatggagtggtgacgagaccggacgtattacagcgacggttgtagcgtttgtcatcaactatgcatgttatttctctgttatattcagaggtggcatagagggtgttccggccggtcagagagaggcaggacaggtgttaggcatgacaaagcagcagattttctttaaaatcactctgcttcagatgatcaagcgtgttgttccgcctatgtcaaatgagataatcactcttgtaaaggatacttctcttgccagaattattgcggcatacgagcttacctttgcgggagcggcgtttatgaagtctgacggacttacatggccgctgttttatacaggtgtattttatctcgtatttgtcggaatccttacacttttatttaattatatcgagaaaaagctggattatttcaggtaggaggaagacatggcaattttagaggttagaaatatagaaaaacactttggaaggactaatgtgcttaaggatgtcagcttttccatggaggagggcaatgctcttgcgataatcggttcatcaggctcaggaaagactacgctgttacggtgccttaacttccttgagagacctgacagtggccagattattgtaaatggtgagactctttttgatgcttccgaagcgggcaaggataaagacgcggagcttcgcaaaaagaggctgcattttggtatggtgtttcagcagtttaatctttttccacagtacacggcacttgagaatgtcactctggcagagcgccttctggcacaggagacacctgagtttaaaaaggataaaaaagcaatccttacacgtattgatgagcatggaaaggagcttctggacagaatggggcttgctgagaggatgaaccattatccgcatcagctctcaggtggacagcagcagcgtgtagctatagcaagggcactggcacttaagcctgatatactctgctttgatgagcctacatcggctcttgacccggagcttaccggagaggtgctcaaggtcatacgttcccttgcgcagcagaataccacaatgattattgttacacatgagatggcctttgcgcgcgatgtagcagatcaggtgatctttatggacggtggtgtgattgttgagcatggcgacccacatgaggtgattgaccatccgaaggaggagcgtaccaggcagttccttaccagatatgcgaacggctgatgtgtgagaaatatattatacatgtcgaaaaagtgtgaaataagtgtaaattgaaaagtagatattgatttttttttaacaaacatatatactaacaaaagaaatggatgtaaatccataatttatagaaaagaggtttattcaaatggcaaatgttgatttaacaaagtatggcattaccggaacaacagagatcgttcacaatccttcttacgagacattattcgaggaagagacaaaagccggccttgagggttacgaggttggtaaggagacagagcttggtgcagttaacgttaagacaggtatctacactggacgttctcctaaagataaatatatcgttatggacgagaattctaaggacacagtatggtggaatacacctgagtatccaaacgacaaccatccaatgaaagaggatgtttgggcaacagttaaggatcttgctaagaaagagctctgcaacaagaagcttttcgtagtagatgcattctgtggagcaaacaaggatacacgtatggctgttcgtttcatcgttgaggttgcttggcaggctcattttgtaacaaacatgttcatcaagccatcagcagaggagcttgagagcttcgagcctgatttcgtagtttacaatgcttcaaaagcaaaagtagaaaactacaaagagttaggacttaactcagagacatgtgttgcattcaacatcacatcaaaagagcaggttatcatcaatacatggtatggcggagagatgaagaagggtatgttctctatgatgaactacttcctcccacttaagggcatcgcttcaatgcactgttcagcaaacgctgacatgaacggagagaacacagcaatcttcttcggtctttcaggaacaggtaagacaacactttctacagatcctaagcgtcttcttatcggagatgacgagcacggctgggatgacaacggcgtattcaacttcgagggtggatgctacgctaaggttatcggtcttgacaaagagtctgagcctgatatctacaacgcaatcagaagagatgctcttcttgagaacgttacagttgctgatgatggaaagattgatttcgaggacaagagtgtaacagagaatacacgtgtatcttacccaatcaaccacatcacaaatattgttaagccagtatcttcagcaccggctgcaaagaacgtaatcttcctttcagcagatgcattcggagtacttccaccagtatctattcttacacctgagcagacacagtactacttcctttcaggatttactgcaaagcttgcaggaacagagcgtggaattactgagccaacacctacattctcagcttgcttcggacaggcattccttgagcttcatcctacaaaatatgctgcagagctcgttaagaagatggagaagagcggtgctaaggcataccttgtaaatacaggatggaacggaacaggaaagagaatcacaatcaaggatacaagaggaatcatcgacgctatcctttctggtgatatccttaatgctccaacaaagaagatccctatgttcgatttcgaggttcctacagagcttcctggagttgattcaggaatccttgatcctcgtgacacatatgctgatgcttctgagtgggaggcaaaggctaaagatcttgcagagagattcaacaagaactttgttaagtacacaacaaatgaggctggtaaagcacttgttgcagcaggaccacagttataataaatatattaaacagaattatatcggataattctaaagccgggcggttgtatgtcgcccggctttttttgaagatactgtataaaacgttataaaacaggcatttatcgaggttatggatgtataaatattgttattgataatatgaatttaagttatattaacgatattgcttgacaaatacagattatagtaatattatcatcatgtgaacagaaataatagaaattgtgaggaaggtttttcgatgagaagacaggcattatctcttttagttgagaacaatcccggagtgaccagtcgtatttcaggactgttcagtcgcaggggatttaatattgatagtttctcctcaggggttacagcagatccgcgctacacacgtatcacaattgttgcaagtggtgatgagcaggtgcttgagcagatagagaagcagttggcgaagcttgaggatgtacttgatatcaagaagcttgagccgggactctcagtgtgcagggagcttattatgataaagataagagcactcgatacacaaagacaggcagttatgaatgtgactgagatcttccacggcaagatagttgatgtcactcatgactctatgattattgagctcataggtacacaggacaagcttgataagttcatagacttacttagcggctatgaaatattagagctcgcaagaacgggaatcacaggacttaccagaggttccgatgatgtagttatgttggattagtcacaggacaatccttacatataaatagtttacttaaattaacaggaggaaaacaaaatggcagaaccaagattattttatcaggatgattgtaacctttcattattagagggcaagacaattgccattatcggttacggcagccagggacatgcacatgcacttaacttaaaggattcaggatgcaatgtcatcatcggtctttatgagggcagcaagtcatggaagagagcagaagagcagggcttcaaggtatatgtcgctgcagaggctgcaaagcaggctgatatcatcatgattcttataaatgatgagttacaggcagatatgtacaagaaggacatcgagccaaaccttgagccgggcaacatgcttatgttcgctcacggcttcaacatccactttggatgcattaagccaccaaaggatgtagatgtagctatgatcgcacctaaggctccgggacatacagtacgttcagagtaccaggcaggaaaaggaacaccttgtcttatcgctgtagagcaggatgctacaggaaaggcatgggaccttgcacttgcatatggtcttggaatcggcggagcaagagccggacttcttgagacaacattccgtacagagacagagacagacctcttcggtgagcaggcagttctttgtggtggtgtttgtgcacttatgcaggctggtttcgaaacactttgcgaggctggttatgacccaagaaacgcatacttcgagtgtatccatgagatgaagcttatcgtagaccttatctaccagtcaggcttcgcaggtatgagatactctatctctaatacagctgagtatggtgattatgtaacaggacctaagattgttacagctgagacaaagaaagctatgaagaagattctttctgacatccaggatggtacatttgctaaggagttcttacttgatatgtcaccggcaggacgtcaggtacacttcaaggctatgagaaagcttgcttctgagcatccttcagagaaggttggtgaggaaatccgtaagctttacagctggaatgatgagagcgacaagctcatcaacaactaatctgtcagatatatatgacaataagacccggggcagtgatgcaccgggttttttatatagcaaaacttgacaaaatatagtgtgatgtgtaaaattatgaatgttaatcagacggattaaaaatacgccttcgtctctttgagaggcggagcgtttttgatataaggaggcaagtatgtcagaaccatacaatcacaaggccatagagaaaaaatggcaggaatactggaaagaacacgagacattcaagacagatgtttgggatttttcaaagcctaaatactatgcacttgatatgttcccttacccttcaggagtaggccttcacgctggacatccggagggctatacagctacagatattatgtcgcgtatgaagagaatgcagggctacaatgtacttcatccgatgggatatgattcattcggtttaccggcagagcagtatgctgtaaacacaggtcatcatccaaacggtttcactcagaagaatatagagaccttctcaaagcagttaagagagcttggttttgattatgactggtcaaagatgatttctacaagtgaccctgagttttacaagtggacacagtggattttcaagaagctttatgaggccggatatgcaaagcatattgatatgcctgtaaactggtgcgaggagcttggaacagttctctcaaacgatgaggttatagatggcaagtcagagcgtggcggctatcctgtagtccgcaagaacatgaaacagtgggttattgatcagccggcatttgcagaaaagctccttgaggggcttgatgagatagactggcctgagtctaccaaggaaatgcagagaaactggattggcaagagcacaggtgtcgaggtcaaattccagattgtaggcggtggagagttctctatctttactacatgtatcgagacaatatatggtatcacatttatggtgcttgctccggacggagatatagtaaagggtctcatggacagagtcgagaacaaagaagaggttcaggcttacatagatgagactgtaaagaagagcgatatggacagaactgagcttaacaagacaaagtcaggctgtgagcttaagggacttcattgtatcaaccctgtaaacggcaaggaagtgcgaatgttcatcggtgatttcgtactggcaagctacggtacaggtgctgttatggcagttcctactcatgatcagcgagatttcgagtatgcacaggctcatgatattgagatgattcaggtaattgatggtgcagatgtatcagagcatgcatttgagaagcatgattatcttggaaagggctgcaagctcatcaactcagaggagtttaccggaatggtagttgaggatgctaaggaagctatcacagccaagcttgagaagatgggcgtggcaaagagaactgtaaactacaagttccgtgagtggatttttgcacgtcagagatactggggagagcctgttccatgcgtatacaaggaggatggttcaatctatttccttcctgatgatgagcttccgcttgtccttcctgagcttgaggattacaagggcaagaatggcaaggcacctcttgagaacgctacagagtggaagcagtatgacagaaacggcgtaaagggtactcgtgagacatccaccatgcctggctcggcaggatcctcatggtattatatgagatatattgatccacacaatgataaggaatttgcaaatcaggagctcttaaagcactggatgccggtagatctctatgttggtggaccggagcatgcggtaggacacctcatgtattcaagaatctggaacagattcctctttgatcagggcttatctcctgtaaaggagccttttaagaagctcgtacatcagggaatgatccttggatcaaacggcatcaagatgggcaagagattcccggagttcgtagtaaatcctagtgatgtagtcgaggagtacggcgctgatacacttcgtctctacgagatgttcatgggaccgcttgaggtttcaaagccttggaacgacagcaacgtacagggagcaaagagattcatcacacgtgtatggaatttctttacagagcctgagaatattatcgaagaggatgacggaaagctcacaagaatctaccatcagacagtaaagaaggtcacaaacgacttcgaggcacttggctacaatacagctatcagccagatgatgatttttgtcaatgaagtatacaaggcaggcagatgtcctagagagtttgcagagggacttatcaagatgctttcttgtgtatgtccacatgttggtgaggaaatctggcagagaatgggacatgacgatacaatcgcatttgagccatggccggtatacgatgaggcaaagactgttgaggatacagtagagattgctgtacagatcaacggaaagactaagggcactcttgcaatcggaaaacaggatcctaaggatgaggttatcgcaaaagcaaaggatgttattgcagataagcttacaggaaatatcgtaaaagagatttatgttccgggacgtattgtaaacatcgtaatgaaataaaaattacccggtattttgcacagccactagacggccggcagaataccgggtgattttattttttgagaacatgtggtggaagagatggatcacttccgcgaagcttctgcataccgcgctggatcgcatccttggaatttttccagtcggcatctttatttttataatcatatttttcgatgaaccatgcaacatcttcatatatgcggttcatgttgtcgtgcattagagggagcacgatatcgtaaaattctttgcgcttatcaccttttaaataagtgtcagctccttccagaaccactttcaggtgatcgagacaaaatccttttgtgttctttaatttttcttttagttcaggatccttttcatacatagtgaagaaggtcttcatgtatgcattaaaggtcttgtttacgctgtcacatataaagcaggttgattcacgcttgttaatccagtccacgatggaattggaggaggcgtctgcttttttgaaaagaccgctcctttgcactgaatcaggcttaaagttcttaaattctttgtccatctcctcaatatggcgcatgtacatggtttttagtatccaggcgtttccgagtgaattgccatagtcaaacatttttttgaaatgtgcacggcagaagccctccttatcggtcatatcgcgtatgtcagcctccatgtaagaggcaccatgaccaagtacaaaatccatgacgtgatcctcagtgcgtttttctatatagcagaagggacattcgccggcattgtcaaaggcgtctgatatggggatagtgtgtatttgctctttcaaggtaatacctccggggtcatattttgttatttaaaaatcctctggtgtgtagctctcataaaacttgataaaggtctgcagagaggtggaaagctttgaagactccttgtaagcaaagccaacctcacgcttgtggattggtatgccgagaggaatttcaatcagggtaccgtcagcaagctcctttgaaactatgctttttatgacgcaggccacacctacgcctattttggcaaagtcgatgagcaggtccatatttgatatatctatagagtcctttacgtgtatctggttctcctgcagataatcatcaatatatttacgtgtcatattgcctttatcgagaagcatgagagtagagttttgcaaaatctcgctctttttgacaccacgggcgcttaagttgcgcagatagtcctttgtagtgacaaatatatcttcgatgttgtccagataatagaaattgaaagtcttaagggatgctggttttccaatcagacctatatctattttgtcatcatcgaggagctttaaggtttcattggtggactgacattcgattgagatgcttatatgaggatttctgtgtatgaattccttgagatatggcaaaagcatatatttgcagagtgttgagctgacaccaatcttaagctggccgacaccgagctctattgagcgcttcagcttttcctccccctcatttaatgcctcaaaggcctcgcttacatgatcataaagaagtctgccctcatcggtcaagacgacacctctggagcttctggaaaaaagcttgcattccagtccgtcctcgagcttttgaattgacttgctgatggcaggctggctgatatagagctccttggctgcctttgatatattgccggcattggcaacagtatagaaaatccagtaagatgagagattctggttcatttgtacctcctgtggtttgtacttttaatgggctgtaatcgttgcttgtcacaaaaaggtgtgaacatcaacaaatctgtgtttattataccatgagatttagttatggtaaatatgtttattatgtatttttattatggtaaatcatatgttatgatgtcttaagtaaacttgattcagatacaatcataatacaatatttttatatgctaggaggaatataagcatgggaatgacaatgacacagaagattcttgctgcacacgcaggccttgactctgttagtgcaggccagctcattgaggctgatttagatcttgtgcttggaaacgacattacctcacctgtagcgattcatgagatcgacaagatgaaggtagagggagtgtttaataaagataaaattgcactcgttatggatcactttgcaccaaacaaggacatcaagtcagcagaacactgtaaatgtgttcgcgagtttgcctgcaaaaacgagattacaaattactttgatgtaggaaaaatgggcatcgagcatgcacttttacctgagcagggactgactgtagcaggtgatgtgattataggagccgattcacatacatgtacatacggagctttaggagccttctctacaggcgtgggaagtactgatatggcagcaggaatggctacaggcaaggcatggtttaaggtgccttctgccatcaggttcaatatcgtcggaaaaccggctgagtggatcagcggcaaggacgtcatccttcatatcatcggtatgattggtgtggacggcgcactttataagtcaatggagtttgtcggagatggacttaaatatctttctatggacgacagatttactatcgccaatatggcaattgaggccggcggcaagaatggtatcttccctgtagatgatctcacaagagagtacatgaaggagcattcaaagcgtccgttcacagagtatgaggctgatagtgatgcagagtatgatgaggagtatacaatcgaccttagcacacttaagtctacagtttcattcccacatctgcctgacaatacacgtaccatcgatgaggtgggtgatgtaaagattgaccaggtagtaatcggttcatgtaccaacggtcgtatggatgatctgcgtattgcagcaaagattcttgagggtaaaaaggttgcggatggtatcagggttatcgtgattcctgccacacaaaagatttatcttcaggctatggaagagggccttcttaagacatttatcgaggctggtgccattgtgagcacacctacctgcggaccatgtcttggcggatacatgggagtgctcgctgagggcgagagatgcgtatctaccacaaaccgtaactttgtcggacgtatgggtcatgtggattctgaggtttatctggcaagccctgctgttgcagcggcaagtgccatcacaggtaagatttcaggaccaaaggatgttatgtaaagattggaggaatcacaatgaaagcagcacacggttgtgtatttaaatatggagacaatgtcgatacagatgtaatcattcctgcaagatatctgaattcttctgatcctaaggagcttgcaacacactgcatggaggatatcgataaggattttgtaaataatgtaaaggccggagatatcatggtagccaacaagaacttcggctgtggttcatcaagagagcatgcaccgattgccatcaaggctgccggcgtaagctgtgttatcgcagagacatttgcaagaattttctacagaaatgcaatcaatataggccttcctattatcgagtgccctgaggcagcaaaggcaataaatgccggtgatgaggtgacagtggactttgattccggtatcatcacagatgagacaacaggagagaagtttaagggacaggccttcccaccgttcatgcagaagattatcgactgcgagggacttgtaaactatataaatcagaagtaattataaaaattcccgaggttatataaccgcgggagtttttagtacaatattaaaagtaatggtaatatgcaaactgtgggatatgcgttctataaatcaaattgctgcagatactgcaaatatttatcggaaactgtcacagaagtgtaaatatccgcgtattccttgcctgatatactttcgatatagttttcgggatagtttttttctatgccatgtgcatgagccatatcgacagctttattgtatgcaatagcggccttttcgattgtgttgtaggttcctatgacaaaattgccgtttatgtgtatgcgagctttatatttgtcgagccctgcagttttgacaatctctacaccatggtatggatttaacagcttgatgttttcgtagcgcatgtcggttgaatcgttgtttacaaatacatagtcccgtccgcaaacagcatgaggctgtatgccatagcggctaagcagggtgacctgcatgccgtagtcgttgacgtacagatgtccctggcgttttaatatgcgatgctcagagtagtaaaacaaatcatctatatcgaatttcagctcatgtgatatatccagatagtagctgaaatagtttttgcgcaggtatattggggttttgatgtacattccgttatcacggaaattaataagagttacaattttatcaaatgcaagtgcatgggtgtgaaagtaagagtcctctatgctgtttgtttcttttaataaaattgtcgatgcagtggcataggcgcggcttgcagaaagctcactgtcaaagcttccgagactgatgtgtttgcttttgtaggtgatgttggacctgtagtaaatggtgccgtcttttctgacagcggtgtaaactccctggagcatagatataatttgtgttcctttcacatatatttttaatcatatatatattattgtagcatttttgttattgatttgatatatgaaatttattatactataaaggataataattgtctgcatatagagatgtagcaatatggatttagagataaaaagagaaatgaggtaaaaaatggatttattatattcaagcacaagaaacagtgaaaagaaaataacagcttcacaggctatccttaagggccttgccgatgacggaggattatttgtacctgagagcattccggcacttgatgtttctgttgaggagctttctaagatgtcataccagcaggtagcatatgaggttatgaagcttttccttacggatttcacagaggaagagcttaaaaattgtatcaacagggcatacgacagcaagtttgatactactgagattgcaccgcttaagtttgctgacggggcttactaccttgagctgttccatggctctacaatagccttcaaggatatggcattatccattctgcctcatttacttatcacatctgcaaagaaaaacaatgttaaaaacgagattgtcatcctaacagccacatcaggagacacaggaaaggcagctatggcaggctttgctgatgttgaggggacacagattatcgttttctatccaaagaatggtgtcagcccgattcaggagaagcagatgcttacacaaaagggtgctaatactcatgtagtgggtattcacggcaactttgaccaggcacagtcagcagtaaaggctatgttcaatgataaggctcttgcagagacgatggatgccgcaggctatcagttctcatccgctaactcaatcaatataggtcgccttgtaccacagattgtgtactatgtatatgcttactcaaagctttttgcacagggagctgtcgcaaaggatgagaagataaatatcgttgttcctacgggaaactttggaaatatacttgcagcgttttatgcaaagaatatgggacttcctgttgcaaagcttatctgtgcttcaaacgagaacaaggtgctttacgatttcttcacaacaggagagtatgataaaaacagagagtttatcctcacaaattcaccatccatggatattctcatctcttcaaaccttgagagactcatttaccgtatcgcaggaaatgatgcaaataagaatgctcagcttatggcttcgcttgctaaggatggcaaatacactgtaacacctgagatgaaggaaaagctttctgacttctatggaaattacacaagtgagaaggaaaccgctgaggttatcaaaaagctttacgaggatacaggatacattattgatactcatacagcagttgcagcaggtgtatatagcaagtataaggatgctacaggtgatacagccacaaagactgttatcgcatctacagcaagtccattcaaattcacaagaagtgtgatggatgcaattgatcctaagtacgattcaatgacagactttgagcttgtcgatgagctttcaaagcttggcaacgttaaggtaccaaatgccattgaggaaatcagggatgcaaagattcttcacaacacagtctgtgatgtggatcagatggaaaacactgttaagaaaatgctcggtgtgcagtaataatataatgttaccttttgcccatttaatcatataattgtaatttgtttgatatataattatatatagcgcaacataaaagaacatctgctgattgcagatgttctttttgtgctctaattatagagtaaataattatcagattactgaaaccgccttgcagagatattagaattcaataataaagtgaatggctccgaaagggtataacagcttgagcttgcaggctttattgaagctgcgtgtctgtccatcaaaatgctcaggtgcagtgagagtaagctcaagtgcctgatcatttgaacagttgaccagaaacagtccattgttcaggttcaggaaatcatcgagagatgcctgtacatactcgtcgtatactgaaaatgattcatttacatagcgtgatgcaaaattgatggctgttgtctgactcatgcctatgtatgtagatatggcatagctgccctcgatgtcctgacgtaccatgcagtccgcactaaagctgtcacatatctcggcagagagcggagtgtagtcatcaccgacaaatcggataaagctgttaaacaaaagctcaagatacataatgtcaatggcagaaggatctatgcctgtattggcaaaaaaatgacctatcagatgatttatactgtccttatcctcgagtaccatgtcaagatcggaaatagcattctcactgcggtaatcatgtatactcttttcgagagtggtattgtcaattatgcctttgtctaaaagaatctgtcctaaaagaagaaagtcagggctttggatgtttaagagctcctttacctgctcgtctgtcagatagcccatttctattgtgagctcaccaaacttcttgtcctgatgggtctgctcgactattactgaatcaacctcggcagctgtcataagccctgagtggatggcaagagtaccgagctttgcgtgcttttgtgctttttctttgagtgcgtcaaaaagctgctcattagtgatatacccctttgataggagaaaattgccaaaaaattgagtatacatattaatttcctcctatgtgcttcttaatcagacttatgacctgatccttgtcgattggtttctgaatgaagtcacatgctccggcagcaagagcctttttaagctcggactgtgtgccgacagatgatgcaacaaagatggtagcacggctgtcatactccataatttctgagatagcggcatttccgtcctttaccggcattacaatgtctataaatgtgagatttggcttatgctccttgtacatatcaatggcgagctgtccgtttgccgcctcaatgatagtcggtgaaccaatggaattgattatgtccttcatctgttttcttgcgagaatcgaatcatcgcatataagtatttttaaatcgtcaagttgcattttaaaactccttccccttgaaaatataaatatattttactacattaataatagaaattcaagaaatagttgggacttatttaccatttattttttccttacatgaggttatactaattttggtgattttacatatttttgtatatataagatccgtgataactatttaggaataataaataaagatacaggagaaagaagcatgaactattttattataatagatgcggtcacgctgatattaggaatttacataatatttgtgtcactacgaatgaagaaaagcggcaaaattgaaagcacctttgtggctgaggatgagatgaaaaagataaaggatacggccggatatatagcttatatttatccaaagtcgcttgtattcggcattgtgatctttgttatcagtatagttgcgatagtttcggattgcctcaaaaaaataccgtactggtcatatgtggagatgattatattcgtcgcagtaattatctggttttcaaatatgttacgaaatgccagagaaaaatttgttaaattctaacatgaattttgcattgcaacatgagacataataaagtataatgaatttacaaagatacctgagatgttcgacaaccctgtgtatttagaacctacatttactttaaacgggattcctatatgagctgttggatgtcaggccgtcattatgcagcggaaggcagaaggcagactgcggttacccacctagcaagagcgctaggagtctaaattacaggaccggcattttgggttcttacaaaagaataataatgtaccaaagaactccggacgcacaaaagatttatgagatacaaaagatttttaaagcacaaaggattcttaagtacagatgataaagggagctgtttttgcagctcccattttttgagcagtaaccactatttgggtgttaaggagaacagaaatttggcaaatagaagacgaagacggcaaaagccgaatcagatggtctggataatgcttgcgataaccatggtatgcgtggttattgtttttgcaattgttatggcgcaaaaggaaaaagggacacttgtaaaacaggcgaaggcagtgacgaaggatatggtgtatgagaatgcatatattgtgtcaaatgacgatggaaggctgattttcatatgtgatggagatctatacagggcaaagggtaccatggaagagaactttacaggtgtctgtgatattgaaatcagtggctctaaggtcaaaaagatacagataaagccggatgatatatcaggtgtgatgctgtcgtacggagacggtaccatgcagattgcagggcagggtgacattccaatgcagtcaagcgagctgccggtgtatgatgagacaggcacttcacctaaggaaatagcggtttctgacctgataatcggaagtgaaacactttcttacatacttgattccggcaggatatgtgccatcgtcagaagacaggcaccagaccttacatacataagggtgcttataaaaaacgatggaaaggatgcatttccaacaattgcggcagctgccgcagctaacctttatgtggatgatgctgactgcggaagcaatgctattgacgatgtgggtgcatatatggcaaatgcacagaaaagtaagataaaggtgagctcagcggacaattatgtcagcataaacggtaagagctatccgggctcatttgagtttatcgggacagaggaaggtattgtggcggtgaatacagtcgatgtggagacatatgtgcgctatgtgctgccgtcggagatgccgtctacatttgatgcagaggcgcttaaggctcaggctgtttgtgcaagaacctttgtatattcacagatgaaaaatacacagtatgcgctatacggagcaaatattgacaataccacggcttttcaggtctataacgcttcagaaacaaagcagtcgaccgatgaggctgtaaaagctacggcagggcaggttgtctcatgtggaggaagcttaataacatgttattatttttctacgtctgccggaaaaaccgaggatatggaggtatggtcttcgagtacaccggatttcatacacaaggtggagtcggtggatgacaattcgccatactacagatggacctcggagcttgatttatcggcatacaatgatcctcagtacggcacagcaacaggtatttctgtcgataagacgtcagatgctggttatgtactttcgcttacaataaattatggaaacaaatcgcagacctttacggcggagaatgatataagaaaggcgttagggcattatcagaaaaaagttacattaaacgatggctctgcgagggagaatatgtcgatgataccaagcgcctgctttagtgtgagtgccggtgcaaatggtcactatacactgtccggaggaggcttcggccatggaataggctttagccagtatggggcagacaagctggcaaaggcaggaagcagctataaggatataatcggatattattacaaggatgtgacagttgtggatataagcagcttaaaaaattaatagcatggatagtagaaatgtggtaatatcgaagtacttagacacatgagtatgtgtgtggtagcaggatacatttagagaacaagaggatttgacaatgaatttaccgatagagtttgaaaaaaagatgaaggcctttcttggcaatgagtgggaggagttcttatacagctatgacaataaccgttttcaggcgcttcgctttaatacacttaaagtcggaaaaaataaaagcgttgaagaagaaattgccggaataatggataagctcggcataccgatggacaaaaaagttacgtgggcgaacgatgcttactattatgacgaggaaaaacgccccgggaagcatccgtatcacgagatggggctttactacatacaggaaccaagcgcaatgtcggcggctgctcttttagccccaaagccgggcatgagagtgcttgacctatgcgcagcacccggaggaaagagcacacagcttgccacttatttaggagacagcgggcttttggtgtcaaatgagattaacacacaaagaagcaggatattatcacagaatatagagcgcatgggaataaaaaacgcaattgttacaaacgaggacagctttgcgcttgcagcacattttccgaattttttccatgcgatacaggtggatgcaccatgctccggtgagggaatgttcagaaagctccctgaggctgtaaatgagtggagtccacaaaatgtggagatatgtgccgcacgccagaaggagatacttgacaatgcagcggctatgcttaaagccggtggaacgatagtctacagtacctgcacattctcgcaggaggaaaatgaggacgttattgagtattttttgaaggagcatactgattttacagtcgtgaagatggaacgtttctggcctcataagcaggatggtgagggacattttgttgcaaagcttgtaagacgtggagaacttctgttagaagagactgtatccacacaggatagaacaggatccatagcaaaagattcactggaaaaaagaaaatcttccggtaaaaaagacaataagaaaagcaaaagctcaggcggaaaagaaaacatggaactattgaatgaatttcttgatgcaatacttacagacgatatggcagaatggatcagaaacggaaagcttgtgatgtttggtgaccagctttatcgtctgccggatatagatgtcgatttaaaaggcctcaaaatacaaagagccggacttcacataggagagttcaagaagaaccgtttcgagccgtcacattcgcttgcactggctcttaaaaagagcgaggcagaaaacacagtggtgcttacatgtgacgatccgcagacaaacggattttttaatggactgtcgatcatgttgacgaaagagcaggcagataagtgtaaaaaaggctgggtgcttgtatgtgtggacggctatcctgccggatggggcaaggtgaatggcacacaggttaaaaaccattatcctaaggggcttagaaataaaatataaatcaaaatataaataaaatagaaaaatttttacgtctagatgtgaatttatataaagcttgactgataacatgaatttttatataattttagtggttatatattaaaaacacaggaggaatggaaggtatgaaaaccaagaagatttctggctttttggcggtgctatgcatatttgcagtaatgctgccgtcaacgatctttgcagcagaggcatctcaggaaggcttaagggcaacgttgactacgggggcagagtcctacacataggcagaaaacattcaggccacacttactgtgaccaatgagaatgcttatgcagtagaaggtgtagaattaaaggcacttgtgccggaaggctatgaactggcggatgagagtcagcagggagagatgaaagtagattcacttgcagcaggtgaatccgtacagttagctgtagagttaaaaaacacagctgctgtagaagagacaacagatgaggccactgtagacgaagctaagggagcagcaaagacagaagaagagaccacaatcgctccgaaaaaggcaaaagaagaagtagatacaaagaaggcagaagataccacaaatacaggtgataaccagaatatggttctctggattgcagtatttgttctttgtgtagcaggcatacttggaattggtacaaagaataagaagggcaaatccttcctttccaagttcctttgtatggtacttgtgactgctgccgtatttgaatcaggtgtaaccatggcttctgccgcagagacagcagaaaagaagacatttaccgttagccaggatgtaacggtggatggacagaagattacattatcagcagaagtttcttatctgccttatgaggaggatgtggaaagcaccaccattacaagagaagaatggatttcctatctgatgcaggtacttgagcagcctgcacttacagatgtacagttctcatttgatgattctgaaaatgcagatgaaccgtctgtcttggaagcagcaatccagtgcggtgttctggatgcacagccagacggcgacaacatggtatatgtaaatccaaaacaggtagctaccagagaatttattgcgtatactgcagtaagagcactgggctaccagctttcggaaacagatgcaccagcgtggacagatgcggcagaacttgcatatgtaaatgaagatgtaaaagcagttgatcttggaatcatcaaactgattgatgaggcattccagccaaatgcagtgattacagaaaaggcacttcgtaatgcaaaatctgtcattgaagcaattatcgcaggcggttctgcaggtggttccggtaatccggttgtaaattatgcagacggtgtgacagaaacatatgctacatatgaagtgaatcaggatgcaatgaccgttctcatcccgggaacagagtatgcttttgactgggcagcaggagaagtacatgtattgcgccacgaagaagatgcaacacaggacattgcaattaagattgcatccattgaagtaaatggtgagaatacactgattcactacacagagccggagctttctgaggttgtaaaagactttgatatggaaggaacagagtctgaatccggtacatttacaccggcagagggtgtgacaattgaaaatacagagctggcatatgcaagagcacgtgcagcagcaagcggttctgtttcattatttggtaagaaaaaagtcagtctgaatattgagatgcaaaacggaaagacttcaacagttacagttggactggatatgaagaatctggaatatcggtttgtagcaagtccatccgcgcatattgtaaatattgatgaggcatatctggcacttaacagttctgttgatattgagtgtgcatataaaaaagaatatgtatcttctccttcagaagaagcagacaaaattaagctgggtgattttaacgtacctctgggatacggttttaatgcatcaggcgaaatttacctgacttactcagtggaaggcggattttctatttcttataccgtcaacagcaagcttggtgtacagtactctgatggcaatggaattcgttcggtatcccgtatcagcacggaaggaccggatcttaaggcaaatggatctgcaaagattggtgtagatgtgcagccgggagctgaatttttaggcattgacctgatttcagttggtattgaagccggagaagcagtagatggttcacttagcaatgtgaatctgcttacagcaccaccggaattctgtctggatgcaatattgtacctttacacaaccatctatgcacagattggaccagatgccctgaatctgagattggaaagagaaatctttaattcagataattctatcttaaagaagaatcttcattttgaagaaactggacgtgtagctgaatgtacacgtggatatggaaattatcagggaaatgtagtgcgtgccgataacacttctataccggttcagcgtgcgaagattcaggtatacaaaggaaacagaatcaaagataccacttatgcagatgcatatggaaaatttgttggtatctcacttccggcaggtacttataagattcgagtatccgcttccggataccgcccatatgagcagcagtttgatgtcattggcggagagaccacaacgcttgaaacacagcttatgatttccaatgcagatgacggacaggaaggaacaatcggatgctccggtaccatcatcaatgcactgacaggtcgtcctgttgaaggtgcaaccgtaactgtaaagacacagtatttcatgggtaattttgcaggaatcaatcaggtgattgatgaagtgacaacagatgcgaatggtaactatagcttcaacgcagcaagaggtaaatatcttcttgaagttacaaaagacggttttgaaaagaatacacgtaatgtgacattgattaacaatgacttaacacagcagaatgttaccatcaacccggttgcaggagaaatcatcacaggagaaagacttcgtgtggtattaagctggggcgaatacccaagagatttggattctcatatggtaggaccaaagggaaatagtaaattccatgtgttctattggtataaaaatgcagataatgcaaatcttgatgtggatgatgtgacaagctatggaccagagactgtaactattacagaaaaagaaaatggtatctatcattactatgtacatgattttacaaacagaagcagcaacaacagtaaggaactttctaattccggggcaacggtacagatttatgacggaaatacactaaagtataccattcatgttccaaccgataaagaaggtacattatggcatgtatttgattacaattctacaacaggaagaattacgttgtttaacgaattctcatatgaaaaagatcctagagatgtaggacaggatgcggatgtgaccggtacaggttccggatcaggcagagcatttgcaattccacagtatcaggatattgaaaaagattacgaaaaagaaactgctgtgacagaggaacaaacaaccgaagatactccggaagcaacaacacagaagccacaaattgaagcggttgtagaagcaacaacacagaagccgcaaattgaagcggttgtagaagaaacaacacaggagtcagaagttgcagatgcggaagaagaaaccactactggtgaggaagttacagaagcatcagcagaatagtaaaaaaatggaggttattatggaaaatgaattaacagatggggtgattagttcaaaagaaccgcctaaaggagatgagattctttgggaagggaggccttttatgccggcatatctgcttggaggagagggaacgcttttatttacaatcattgtatttgcggtccttacctattggggatatacattaatatggctggattgtctgatgacagctatcgttttatttgaatggatacaggtaattgcacattatacatcgcggcgttattacatcacaacacggggaacggttgtgagaagaaacggcagatattatctgattagatggcagtttatcaatccagagaaattttggatcaggtcaggccttattaatctcttgtttggatgcagaacaatttcgtttgcaagaaactatggattttcatccacacgtggagcaaatgcaaacctgtggcggtatatcggcacatttgcatgcattcgtcatgcagatgaaatcaggaaaatgctggaacaaagaggttgacaatttacaaaaaagtattactatgcaagaaacgaaggcaatggagcacatccattgccttttttgtacactgaaataatctctcggaattctgagtgattatatccagcacagctggtgatgaacattgaaaagtgaatattattcgaaatgaataaaaaaagaatatttgctataactcaaaaatgtccctaacgcgaatatgatataaataaaatataaaaatttttacttgcaaaatatagagattgtgctaaaatgtcttatgtgttattaagacataagcatttgcgatatatatgtcgcagctatatataataaaagcaatgaaggtgcatagtagattatagtactttgaccagagagagattgtcaccggctgaaagcagtcttacaaaaaggctattgattgaagttcacactgaagctgcatggatgaagcaacagtagttcatgacgtgttatgtacgttacacatataatgagagtccatatttataatatatggaaatcagggtggtatcgcggaattttcgtccctgcacggtttaatagccatgcaggggcgtttttttatcgcataaacggcgaattcgagcttggagttacgagtttatgcaaattttaaaaaaattatgaggtgaaattcgatgagagacaaaattcaacagatcagagaaaaagcacttgctgaaattgataaggctgacggtcttgaaaaattaaatgatgtgcgtgctgcaattcttggaaagaagggtgagctcacagcagtcttaaagggcatgaaggatgttgctcctgatgagagaccaaaggtaggccagtgggtcaatgagacacgtgaggcagttgagaagcttcttgatgagaaggttaagaaatttgaggcggaggcactcaagcgcaagtatgagagtgagaaaatagatgtcactatgcctgcaaagagaagcaaaaagggtaatcttcatcctgtaacacaggtaaaggaccagctctcggaaattttcacatctatgggctttgaggtttacgagggtacagaaatcgagaatgattactataattttacagctttaaatactccaaaggatcatccggcgcgtgatatgcaggatacattctacttatcacctgagttcttacttcgtacacagacctcagcaggacagattcatgtaatggaagcaaagaagccgcctatcaaggttgtttcgccgggtaaggttttccgttcagatgatgatgcgacacattctcctatgttcacacagatggagggtcttgtggtagataagggcatcacactgtgcgatttaaagggtatgcttgaccagcttgtaaagaagatgttcggaaagaatgtcacaacacgtcttcgtccttcatacttcccatttacagagccgtctgtagaggttgatgtaagctgtttccagtgccacggcaagggctgctctttatgcaagggcacaggctggattgaggtgcttggtgcaggcgtagtaaataaaaaggtgcttgagggctgtggcatagacacaaatgagtacagtggttttgcatttggtatcggtcttgagcgtattgcaatgctcaaatacggaattaacaacatcaagcttttattcgagtcagaccttagggtattagaccagattgatgacaaatagattcatttcttgaatatataacaggaggcaaaaattatgttaacaccacttagctggttaaaagattatgtagatatagatgtaacaccaaaggagttagaggaaaaattattctcatgtggtttcgaggttgaggaatcatatgaggtgggaaaggatatctcaaacgtagtagtcggtcttgtagaaaaatgtgagccgattcctgagacacacctgagcctgtgtcaggtaaatgccggagcacatggcacattccagatctgctgtggagcggacaatgtaaaggcagggggcaaatatcctcttgcacttatcggcgcaacagtatatgccacagcaaaggatcacgttacaatagagggcgtgatggagataaagcagggcaagctgcgtggatatgattcatatggaatgttatgttcaggcgtagagcttggcttaaatgaagacctctatccgggtgcaggctacaacggacttttggttttacctgaggatgctaaggcgggagatgatgtaaaacctatcctcggccttgatgactggatttttgatattgcaatcacagcaaacagacctgactgccagtgtatatatggcatggcaagagaggttgctgctgttttgggaaaagagcttaaggagcctgcacttgactatactgctgatgatgtgaagaaggaaaatttcaaggtatctgtcctggcacaggacatctgccctcgctacacagctcactatgtgcatgatgtaaaaatctctgagtcaccggcatggatgagaaagcgtcttgcgcttgttggaataggctctatctcaaatgtagtagacatcactaactttgttttaaaagagctcggacagccaatgcatgcctttgattattcataccttgagggagatgagattgtagtaagacgtgcaaatgatggagagaaaattgtcacacttgatgagaaggaatttgagttaaacagcaataacctcgttatctgtgatggaaagaagccagtagcgcttgccggtatcatgggcggcttaaactctgaaattaacgacggtacaacagaggtgatgtttgaatctgcaaaatttgcaagagacaatataagaaagagctcacgtgcgttgggacagtcatctgattcgagtgcactttactcaaagggtgtaaacgagtacacaacagccatggctatgaagagagcgcttcacctgatggaggagcttggctgtggtaaggtttcttcaactcacgttgaggtgactacaggaaattcgcttgagccaaaagagatgaaggtttctattgcaaaggttaatggtgtgcttggaatagaggttcctacagaggatatcgtgagaatactcacaaatttaggctttgcaccggttgtaagcggtgatgagctgacacttatgattcctgcatatcgtgaggatatggaggattatcctgatgtggccgaggaggttatccgtatgtatggctatgatcatgtcattcctgcattcatgcctacggcacaggttacactcggaggactcaaccttagacagcagacagagcgcaagataaaagaggtgctctgtgcagcaggcgcgtatgagggaatacattactcattcttctcacctgctgatcttgatttgctcagattcccggaggatgcacctgaaagacatgctatcaggcttataaacccaatcaatgttgacctctcgcttatgagaacaacacttgcttctgagatgctttatgccatagcaagaaaccagaagaagggaatcctggagggaagaatctttgagctgggaaatatctttatcgcaaaggagcttccgcttacagagtatccggatgagagagagacactttgcgcaggcgtattcggtgaggatgaatcattctttactataaagggactggctgagactgtagcagatgcgcttgatgtgaagtttacatacaagccggctcaaaagccattccttcatccatatcagacagcagaggtattctgtgacggacaaaaaatcggatatctcggtcaggtaagatatgagatatgcgatgagcttgacatgagagtaccggcatatgtgatggagcttgatttaagagttctttcacagtggtatggaaaggacagagtatttactccaatctcaaaatttgatgatgagaagagagattttgcttttgttgtggacaaggatatcacatgtgagcagattgaaaacggtatcagggaagcctgtgattatgtctcagatgttacactgtttgatgtttacgagggtgtacagcttcctccgaataagaagagcatggcgtacagtgtagtatttacaccaaaggatgaggagcttaagactaagaaggtcgagggctttgtaaaggatatacttgctcatcttaaagagactgcaggtatcacacttcgtggttagacgttagtatagtgttaggaataggaaaattatggacgtaaaagattttgattatgatcttccggaggagctaatagcacaggatcctctggaggaccgctccagctcaagactcatggtgcttgacaagaagacaggagaagtcagccatcatgtgttcaaggagattgttaaatatttaagaccgggcgattgccttgtgctcaacaatacaaaggtcattcctgcacgtctttttggcgtgaaggaaggcactatggcaaagatagagatacttcttctaaagcgcagacaaaatgacgtatgggagactcttgtaaagccgggtaaaaaggcaaagccgggcacaaagattatatttggtgacggacttttaataggtgaagtaatagatgtggttgatgatggaaacaggctgattcagtttagctatgagggtatttttgaggagatacttgataagctcggacagatgccattgccgccatacatcacacatcagctaaaggacaagaaccgctaccagacagtatatgcaaagtatgacggctcggccgctgcgcctacggcaggtctgcatttcacaaaggagcttttacagcaggtaaaggataagggagtggatatagcagaggttactttacatgtggggcttggtaccttcagaccggtaaaggtggataatgtgcttgatcaccatatgcattctgagttttacatggtgtcacaggaggctgcagacaagattaataatgcaaagaaaaatggcggcagaataatatctgtcggcactacaagcactcgtaccttagaggcagcatccgatgaaaacggcatgctaaaagagtgcagcggatggacggatatctttatttatccgggatacagctttaaggtgattgactgtctgattacaaatttccatctgccacagtctacacttgtcatgcttgtgtcagcattagcaggcagagagcatgtcctcaatgcatacaaagaggctgtagaggaaagatacaggtttttcagctttggtgatgcgatgtttataacgaacgatatgcatatggacgatgaggcagctgaataaattttacttgtaaaaatcagtcatatatactaatatgttgtttgagggtaatttgttctcttagtcaataatataatagatggggtaaagtgaatggaagaaaagagaagacataaaagacttgacattgatgtatcggtacagttagagcggctggatgaggacggagtgacaacacttaagtattgtcatgtggatgtcacagatatttccagaagcggtataggatttaatgcaaaggtacctcttgatatacatacatattatgacaccaagatccaaatttggaccaaggaggttgtggatgcggttgtcgagattgtacgaagaacagacagtgaagaaggagtatatcactatggtgctgtgtttatcggtatgacagacactgatgcactcaagattgatatttatcagattttcaatgatttataaagtaaaaaaagtaaatcatccacatgatatagtaaccagtgtacctggctcaaagagtatcacaaacagggcccttttaatcgctgcactcgcaagcgggcgcagcgttttaaaagggtgtctttttagtgatgattcgagacattttatagatgcgctgattcgtctgggatttccggttatggtggatgaggataaaagagaaataacaataacaggctttggaggcaggataccaaagaatgaagctgagatagatgtgggaagtgcaggtaccgctgcgcgttttcttacagctcttcttggactgtcaaagggcagataccatatagtgtcctctgagcagatgaagaagcgtcctatgaaggatctgcttgtatcgcttgaaaagctgggagctcatattgagtatgatgagaacgaatatcattttccttttaccatcggaaatacaggggagtatgctgatactgttgatataaacgtagacaagagcagccagtttttgagtgcccttcttatctcggcgatagtgatggaaaagaactttacgattaatgtcacaggaacgcatggtatggcatatgttgagatgacgcgtcttatgatgaagcagtttgggcttgatgtgatgcaggataaaaagaataacagctttattatccctaagaaagcggcgtatgaaagcttagactatgatatagagccggatgtgtcggctgcatgctatttttatgcaatgagcccgcttttacatgttaagtcaaaggtgatgggggtgcaccaaaacagcctgcagggagatgtggcatttcttgatgtgcttgcggatatgggctgcacaatttccgacgaagcagacggtatagtgtgtatgccaccaaagaatgctcatatacatggcggaagctgggatttgtcaacattctcagaccaggcgctgacacttgctgcgattgcaccgtttgcaaatgcacctgtagggatagaaggcatttcgcatattcgtctgcaggagtgtgacaggataaacgccatcgaggaaaacctgacggaattaggtgtgagggttgaagaaactgaaaatggcttaaggatttatccggcagagcgtattaagccttgtaaaatcaaaacgtatgacgatcaccgcgtagccatgtcttttactttgccggggcttaaggcagagggggttgagataatagacccttattgctgccgcaagacctttgagaatttctatgaggtacttgaggagagcgtatattaataccaaaagagccgtaaaacgaaattacttcgctttacggttctttgtctttggattaaagccatataacaggataaatcatctgcggtgaatagtatagtttctttctttaagtacgctgatagccgattcaagagcatcttcgtcatagaactctatgcgcagtacaccctcctcaaactcacggttgtttatgatgccgatattcttgatgctgatgccgttgaaggctaaaaggcttgcaagcactgcaataccgcctgcctcatcggcaatatcgacaaatacttcgtggaaatccttgcggattttggcaccgggaagtgtgagtgaatccctgtaattctttgaatcctggaaataatcaatcatcttttgagaactgccctctgcaattatttcgcgaagcttatggaaattggcttcatactggtccatgagtgagagcagctgtgttttgttggactcacatatgttttcccacatgacaggggagcttgcggcgatacgtgtcacatcgcggaagccaccggcagcgatagttttcatggtctctttttcggaatcaatatgctcaatcagattgacaagagagtatgcaatcatatgtggcaggtggctgatggctgcggtagcatgatcgtgctccctgtagtctaaaatgagagctatcgagcccagtgaaagtacaaactgtttgaaatcattctgattttcttcagtagttgctgcagtaggagtgataatatagtaggcgttctccaaaagctgcttgtctgaattgagtatgcctgttttttcagagccggtcataggatgaccgccgataaaattgcgctcaaggccaagctctataaccttttcgtgaatctgggttttagtgctgcctacatctgtgatgatacagtcatcctttatgatatccttaagctgtgtgaggtattcgatatttttgttaaccggtgcacacagaaagattacgtcgcagtctttaaaagcgttaagatctaaaagctcattattatctatcaggccaagcccaaaggcatcctctatggtctgttgatgcccggctgttgcgataattgagacctttggattattttctttcatttttctggctatagagccgccgatcagaccgagccctataaagccaactttatcaaaatgcatttatgtgtatctcctaattctttattgtaactattcagaatcaccacacgcacattctcaaaatcgcactatagtggttcggaatatttacaatatattatatccaatttaacactataaagcaataaattattggcatatttattccaatataacaataaaaaaataatcgtcagattgcataaaagtgttgtaaattatataaaatattagtacaatgtttacatactataataatgtcagggaggtacttgaaatgaatgtttacactactgagaagattcgaaacgtcgtgcttttaggccatagcggctgtggcaagacatcactcgtggaagctatggcatatctggcaggacagaccaccagaatgggcactgtagcggatggcagcactatcagcgattttgacaaagaagagataaagcgtcagttctctatacatacatcggttgtaccgatagagtgggataatgtcaaaataaatattctcgatactcctggtttttttgattttgtgggagaggttgaagaagctgtatcggctgcagatgctgcaatcatcgtggtttcaggcaaggcaggcatacagacaggcacaaaaagagcatgggagatatgcgagaaatacaagctgccgaggatgattttcgtgacggacatggatatcgacaatgcaagcttcaaggatgtggtattaaagctgcaggagctttacggcaagaaaatagctccattccatctgccaatcagagagaatgagaagtttgtgggctatgtcaatgtcatccaacagagggcaaagagatggaatgaaagcggaggcgtggataagtttgatgtgccggagtactcaaaggagaacctgggaatatgtcgtgaggctttagttgaagctgtagctgagacaagtgaggagttcatggacagatatttcggcggagaggagttttctgatgatgaaatcagggctgcgcttcgtgcaaacgtgcttgagggctctattgtaccggtgctcatgggctcaaatattctcgcaagaggcatgtatacacttatggctgatattgtgaaatacctgccaagtcctgagaagagaagctgtaccggtattaacaccaagacaaatgaggtgtataatgctgattatgattttgcaaaatcaaagagtgcttatgtgttcaagtcgatagttgacccgtacatcggtaagtattcactgatcaaggttaattcgggtgtactaaagacggatgatgtactttacaattatcacagggactgcgatgaaaaaatcggtaagctctatgtgatgagaggcagtaaggtggaggaagtgaaggagcttcatgcaggtgatatcggagcgcttgcaaagcttacaaagactcttacgacagattcgctttccaccagaaatatgcctgttacatatcttagaacaagtatatcaaagccgtatgtggcaatgcgctacaaggcaaagaaaaagggcgatgaggacaagatttcccagtctttacagaaactgttaatggaggatctgacactaaacagtgtaaatgacagtgaaaatggacagactgtactatatggtatcggtgatatgcagcttgaggtagtggcaagtgagcttcttgaaaagtacaaggtggagatagagcttatgcgtccaaaggtagcctttaaggagactatcaggaaaaaatctgacgtagagtataagtacaagaagcagtcgggcggacacggacagtacggacatgtcaagatgacatttgagccgtcaggtgatatggatacgccatatgtatttgagcagacggtcgtagggggagctgtaccgaagaacttcttcccagctgttgaaaagggtattgcagagtctgtgaaaaagggacctcttgcagcctatcctgtgacaggtataaaggctgtgctgtatgacggctcttatcatccggttgattcatctgagatggcctttaaggtggcaacacagcaggcatttaaaaagggcattatggaggcaaagcctgtgcttcttgagccgattgccactcttaaggtagtggtgcctgagggctatacaggtgatgtgatgggtgagcttaataagagacgtgcgcgagtgatgggcatgaacccgacagacaatggatatcaggagatagttgcggatattccttatctggagctttatggatacaatgccacacttcgctcaatgacgagcggaagcggcacattctcatatgagtttgccagatatgagcaggcaccggatgatgtggctgcaaaacagatagaagaaagggcaagcaagcttgttgaagttgaagagtagaatagcattaattatattacttacattgatttttaccaatactcatgtgtttgcatcggagataaaagaggcagaagctgcctcttttgcttccgggccatcactaaatacactggttgacaatatgtcagaaagtgatggcgtttcatatatttactataatctgggcggtgcggcaaataatatcaataattgtggatacatcacaccaaagcagaaattcatgggactaagagaaccccacaaatacggttataaatttgatggctggtatctggatgagcatttttcaaaaaaggcggatgttctgacctacgaaaaagcaaatggatatgtggtatatgccaaatgggtcaggacgattaacaatgaatacagcgtagagcattacaattacaggagtaataaaaaagcgcatacactggcgcttaaggattgcgattacgattttatagatgaaatagatattccgggcatgccggagacgaaggaaaatgattttctcaataattatattttcagtgaggcacagtgtcctcaggggatttgtatcacggacgaatacgtgcttatcacgagctattctgatgacaagggctcactcggggagcttatggtatttgacagggaggacggagagtaccttgtgacacttggcatggatgcaaacagtcacctgggcggaattgcctttgacggggaaaatgtatgggtgtgcaattcctacgacacaactgtggagcgcatctcttatgattttatctctctaatggccactgcgaattccaagcaggtcatcgatgcgacaggtgtggtagatgtgtttgatgtgggaaacaagccgtcatgcataacatactatggaggcaggctgtggatagccactcataatatcctttttaagtcaaagatggtagcatattattatgacaaaaaggacgacaggctcacaagcctgagcacatatacgatacctgccagagtgcagggcgttacatttgatgcctcaggaaaggtatatctgagcacctcctatggcaggaatgagtcatcgtatatcaagtgctacaaatcactcatagctctgtcgtcaaggcctaacagccccgacatcacaatagagatgccgccgggctcagaagagcttgacagtgtggataaaagattgtatgtcatttttgaatctgcgggggagaagtaccttgagggcacggatggcaagggaaactcgcctgcaccgatagacaagatacttcgcataaatacagattcgtttaaaaattaattatagcatttttaaaagcctttcaacctgcctgcggtttttctcaggcaggtttttgcttagctcagtgcacatggaatagacctcttctttggtaaattctatgccgttacgctttgcctctttaatactttccatgagaaacggcatggcacttgttgtgtcctttggcttttccttttgtgcaaaattatttaaaaattcctgctttgtcataaatctccctattgtccaaaactgaaaaaatatttaatagattgtctatcgtatcctgttcacttttgctgcagtatttctttaaggcattgagcatggatagtcttctgtctgacatactttcagtctctgcaacagacagtgcaggtgcacaatctatcattctcattgaattcataagtgatatgtagtgaaccataagagtcatttgcttttgtgagtcatgcggcatatatgggattatggttttaagcatctgaagctcccttgtctgggttatttcatcgaatggtgtaaacaggctgttctcgtccataaaaatcctttaaaatatatttctatataatatgtcacctgattcacattatgcatgtttacagcatatattattaaaaaaagatatatgcttatcatagatggtcacgacgtatacgagatagatgaagaatgcatcaaaaagcacagagtgaagggcgaatgtaaagtccttgaaaagctcaaagaaaaagagcagcgcaggcaaaaaaagaatactgaaaaatcgtaaaaagctgcgggccaaaaagacccgcagtaaaaatgtaaatcagcagccgcagccacatccgcagccgttattgctgctgccgccacagccaaagccaccacagcagaaaagtaagatgatagcccagatacagctgttattgccgcttccacagtcgtttcctccgaagaaagagcctccgttaccatttccacaacagcagcacagtaacaggatgatccataaaatcgaagaacatccgcatccgttgtctgtattgctgcatgaacagtttgttgctgctaaatcactcataagtgacctccaataaaatttatttacactctaggttatgatagacataacaaagtgttacactaagatttaaatttttttattgacacaaaaagtataattgtatacaattattcaaaagataaaactaagcacaggagatgtgaagatgagagaagttttgatgaacgaaaaaacaaatttactgcagcttgaagagcatttttatcagctcgtggatgtagatgagccgaatacttttagaaatctctttccttattcagaagttcctaagatagcattcaatgacagaatagtgccgcacaatatgccggaggacatttggattacagatactacattcagagatggccagcagtcgagagcaccgtacacgacggagcagattgttaccatttatgattatttacataagcttggtggccctaagggaataatcagacagagcgagtttttcctctacagcaaaaaggacagggacgctgtttacaagtgtctcgagagaggatataagttcccggaggttacatcgtggattcgtgccagcaaaaaggactttgagcttgtaaaggatataggactcaaggaaaccggtatactggtaagctgttcggattatcatattttctataagatgaagatgaccagacgagaggtaatgaatatgtatctgtcagtcatcagggagtgtcttgagacaggaataagccctaggtgccatctggaggatatcacacgttctgatatatatggttttgttattccattctgtgttgagctcatgaagctgcaggaggagtacaagattccgattaaggtgcgtgcctgtgatacaatgggatatggagtaaacttcccgggagcagttatacctcgaagcgttccgggtatcatatacggacttaacacacatgcaggtgtgccttcatcacagattgagtggcatggacacaatgacttttacaaggcagtaaacaattcgactacggcatggctctacggagcaagcggtgtcaactgttcactgtttggtatcggagagagaaccggaaacacaccacttgaggctatggtatttgagtatgcacagcttaaaggcacactcgatggaatggatacaacggttatcacagagttgtcagagtactttgagaaggagcttggatatgtgcagccgagccgtacaccttttgtcggcagaaacttcaatgtgacgagagccggaatccatgctgacggacttctcaaaaatgaggaaatttacaacatattcgatacaggtaaattcttaaacagaccacctcttgtagcagtgtccaatacatcaggacttgcaggaatagcgctgtggataaacacttactaccgcctgccggatgacagaaaagtagataagaactcaaagcttgtgaccatgataaagaaatgggtagatgagcagtacgacgagggtcgtgtgactaccatcacggataatgagcttgtagttcaaattactgattgctgtaaaaagcttaatatagtattatagtgaggtggattagtacatgtcacatgataattacagcctgagtgccagagtatacaatcatatcagggatggtatacttgcaggaacatttgcaaagggcgatgagcttaaagaaaagaatatcggtgatgagcttggagtgagcaggactcccgtgagggaggcactgcgtcagcttgagcttgagggacttgtgtctatcatccccaataagggagcgttcgtggagggggtttccacggacgatatcagggatatatacgagataagggctctgcttgaggggctttgtgccagatgggctgcaacgaggatatcggacgagatgatggcagctatggaggagaatatttatctcacggagttccacgagaaaaagggcaatgcaaagcagcttcttgagctggacaataggtttcatgagctattgtatgaggctggcggaagcaaagagcttatgagggtattaaaggactatcatgagtatgtcggcagagtgagaaaggtgacactcggcgagacaaaaagagccaaaaactccactcacgagcataaacagatatgcgaggcaattaagaatcatgacgcactgctggcagaaaaatgcgccagagagcatataaacaattcaaagaaaaatatggaacaccttggttgggagaaccttattaagtaaaggagatttaagaatgagcaagattacgatgacaacaccccttgtagagatggacggagacgagatgaccagaatcctctggcagatgataaaggatgagcttttaataccttttattgatttaaagacagagtattatgatctgggcttagaggagcgaaatcgtacagatgatcaggtgaccgttgaatcagcaaaggcaaccatgaaatacggtgtcgcagtaaaatgtgcgacaatcacaccaaacgcagccagaatgacagagtacaatttaaaggagatgtggaagagtcctaacggcacaataagagccatgcttgacggaacagttttcagagcaccaatcgttgtaaagggcatagagccaaacgtaaagacatgggctaaaccaatcacaatcgctcgtcatgcatatggtgatgtgtacaaggcaacagagatgaaggtagccggtccaggaaaggctgagcttgtatttacagcagaagacggaactgagaccagagaattaatacatgagtttaagggcgcaggagttattcagggacagcataacctggatgattcaatcgagagctttgcacatagctgctttaagtatgcacttgatacaaagcaggatttatggtttgccacaaaggatacaatctcaaagaaatatgaccacaccttcaaggatatcttccaggaaatctttgatgcacagtataaggaagcttttgagaaggctggaattacatatttctacacacttattgatgatgctgttgccagagtaatgaaatctgagggtggatttatctgggcatgcaagaactacgacggagatgtaatgagtgatatgatctcatctgcattcggctcacttgccatgatgacatcagtgcttgtatcccctcacggatactatgagtatgaggcagcacatggaacagttcagagacactattacaagcatttaaagggtgaggagacctcaacaaactctgtagctactatttttgcatggacaggagcactcagaaaaagaggagagcttgacaagcttccggcactttctgagtttgcagacaagcttgaggcagcttgcataaagactattgagagcggaaagatgacaaaggatctcgcactcattacaacaattgaaaatcctactgttttaaacagcgaaggcttcatcaaggcaatcagagaggagcttgagaagacaatttaatctgaaatttggtttttagccttagaataagatataacccggggataattatgaattttttgaatgttaaattcttaacacattgacagatgaccttcaaaaaattataattaatcttgggtttttgtctttaaaagagaaatgatatcctgatgattggaggaataagacttgagtaaagaaatatcacaggcggttatcagaaggctgccacgatactatagatatctcggagagcttttggatgagggagtggagcgtatttcatcaaacgatctgagtcacagaatgaaagtgacagcttcacaaatcagacaggatctcaataatttcggaggctttggacagcagggatacggatacaatgttcagtttctctacgaggaaatcggaaagataatgggacttaacacagagcatagaataattatcatcggtgcaggcaatctgggccaggcactcgccaattatgtaaagtttgaaaagcttggctttgtcataacagcactttttgacgtaaatcctgagctttcaggaaagagtgtgcgaggtattccaatccttatgctaagtgagctggatgagtattgcagaacacacagggtggatattgcggcgctcaccatgccaaagtcaaaggctgactctattgcgtcaaagcttgtggatttaggaataagggctatatggaattttgcacatgtggatcttgaaattccaaataaagatgtggttgtggagagtgttcatctgtctgacagccttatgcagctcagctataatattgttaaaaactccaaaaataaatagagggtgagtcttatgaatgataaaaaagattttgaggctgcattaaaaggaaaaaaagtgcctttactggttttagaccagaagtggcacagactttttgccattcatggtaagactgatgaaatatcagccacggaaaaagaactggatgaactgttaaagttgcagggaaagtacaacaatgagcttaagaatttaaaaaagcttaagtcgaaaattatgtctaatattgttgccaacatgggagatgacggcgatgaaaagcgtgacaaggataagcagcttatagatgagataaatgagaaagctgacaacattgagggagagcttattgaaatccagaagaatataaaagctgtaaatgacaggctgatgcttttatcgatggattatttcagtgaaaagatcgagaaaaataaactggaatcaaaagaaattgacgactggattgcaaatataagagttgaacttaagaaaaatgtaatcagaaaacagaacagagatattaacaacagggagatttattcgtatcttcatgatatttttggcgctgaggttttagatctttttgatattgaatatgacgatcctatggttttcaatgccaataatgcaaatactgataatgcaaacaatgagaataaggggaattgatattggaatatattgttacaggtaatgaaatgaagcttctggacgatacaacatcacaggtctttttggttccttcggtggtgctgatggagcaggctgcggccggtgttgtccgggagcttgttgcatgttttgataaatcaaaggagtttgccgtgatatgtggcagaggcaataatgcaggagacggtatcgcgatagcaagacttttaaatcaggccggatacagatgcatggtgtactatgcttttggcacagatgaggcaggaagcgagctctttgagctgcagaaaaatatatacgcaaggtatggctttaaggtggtctctgatattgagtgcgtgtgtaaaagtgacgtaataatagatgcattgtttggcacagggcttaagcgagccatagaaggctctttagcagatgtgattttagccgttaacaaggcaaatgcttacagggtggcggtcgacgtgccgtcgggagtggattctgataaaggacatgtgatgggatgtacttttaaagcagatttcacatatactttttcttataagaagacaggccttctcctgtggccgggctgtgattattgcggtctggttaaggtggtgcctataggcatagatgaccacagcttttgtggtaatctgccatcagtaagggctcttgatgagtctgatttaaagaaacttgataacagaccggcacactccaacaagggaactttcggaaaactgttagttatagcaggaagccgcaatatggccggtgcggcggtgctttcggcaaaggctgcatacaaaagcggagcagggcttgtgaaaattataacgccggagtgcaaccgctcaataatccaatgtgctttgccggaagcactgctttgtactgatatcgcgtcagctaaagcacttgagacagagcttgattgggcagatgcagtggtgataggtcccggtctttcaaagtctgataatgcaaaaatgttagttgaaacagtactaaaaacagcagagatacctcttgtgattgatgcggatgcgcttaatatcatatcagataacatgactttacttaatgagcataaaatgcctgtcatcgtgactccgcacctgggcgagatgtccagacttatgaaaaagagcattgctgatatacaggaggatatcatcggtgtggcaggagagtttgcaggcttgtacaatgtgacttgtgtgcttaaggattttcgtacgattatcgcagcggctgatggcgaaaagtttatcaatctgtccggcaactgcggtatggcaactgccggaagcggagatgtgctaagcggtatcgtgggaggtcttctggtacagtggcgtgacacgaaaaaggctgcggcatacggtgcatttattcatggacttgccggtgatatggtatttgacaataccggctcgtatggtatgatagcaagtgatattattgatggattagataaagtttggattaaggtggaaaaaaatggcaattaacagaatcagagcagatatagatctggatgcaattttatataatatggagtcgatgcacaataagctaaagccggggacaatgatggcagcagtcgtaaaggctgatggttacggtcatggcgctgaggctgtttcagaggtactggagccgcttccgtatctgtggggctatgccgttgctacaagcaacgaggcaatgcagcttatcgcagcaggcaggaaaaagccgatacttattttaggactcagcttcccggagcagtttgaggagatagtggacaacgatgtgcgcccggcggtatgtacatatgagacagctaaggagctatcgcgtatcgctgtcgctaagaataaaacctgtaagatacatatcaagatagataccggtatgtgccgtataggctttcaggtgactgaggaaagtgcagatattattgcacagattgctaagctgccgaatattatgatagagggaatattcactcactttgcaagggcagatgagctgtcaaaggagcctgcctttgagcagtttgatctttttaagaggatgatagctcttgttgaggcaagaggagtcgagattccaatcaagcactgctcaaacagtgcgggaatagtagaaatccctgagtgcaatatggatatggtaagagcaggcatcacactctatggtctgtggccgtcagaggaggtagacaagagtaaaatctccctaaggcctgttatgtcgctgcacagcagagtagcttatgtaaaggagcttgagccgggcaggcatataagctacggcggcacatttacggtagagcatcctatgatgatagcaactgtcccggtgggatatggtgatggatattcaagaggactttcaaacaagggctgggttctcataaaaggaaaaaaagcacctatatgcggtagagtctgcatggatcagtttatggttgatgtgacagacatacctgacgttaaaataggcgatgcagttactttgctcggtaaagacggggatgagacaatcactatggagcagttaggtgagctttcaggcagattcaactatgagtttgcatgtcttattacaccgcgtgttccaagaatttaccacaaaaactaaaaaagtgtaacttttaagaatacactcgaaaaatctggagatactttttgtataccataatatggagtgtattcgtgtatgattattcaaagaggagatatttattacgctgatttaagacctgttgtaggctcagagcagggcgggataagacctgtccttataatacaaaatgatgtcggaaacagacacagcccgacggtaatctgcgcagcaataacctcgcagatgcataaagcaaagctgcccacccatgtggagcttgcctgcaaggagtatgcgcttgcaaaggattctgttgtgcttttagaacagcttcgcacaatcgacaaaaaaaggcttaaggataaggtgtgccatcttgatgaggacacattgcttaaaatagacagggcgcttgaaatcagcttagaacttattacataggataataaaacattatgttatatgcaattataattttatcaatacttgtagtgatacttcttttgtgtattggagtattgctttatggaatgaaaaacaacaaaaagactctcgatggaatacttggaaatgatgatgtcacagaggaagaaattatttccatggtcagggaggggcatgagcagggaacaatccttgcatctgaggcagagctgatacacaatgtgtttgagtttgatgataaggaagtaaaagatatcatgactcaccgcaaaaatatcgtaagcctcgacggcagtatgtcctttatcgatgccatcgaatttatcatagataccggcaaatctcgctttccggtctatgagaatgatgttgacagtatcatcggagtcttacatatcaaggatgcttttacattttttgaaaaaaatgaggtttaccgcagcagtatcaaggacatagacgggcttatccggccggtggacttcatacccgagacggtaaacatcaatgatctgttcaagaagatgcagtctaaaaagagtcatcttgcgatggttgtggatgagtacggacagatatctggacttatcgcgatggaggatatactcgaggagcttgtcggaaatatcgaggatgagcacgatgaggaagaaaactacattagaaagaatgatgacgagacatttataatggacggcatgactgagttttccgatgtgaaggaggcgctgtcactgcctgttgaagatgatgcctacgagacgcttaacggttttatcatatcgctttcggataagattccggaggagggggataagactgtgattagcgcatatggctacagattttctgttatgagcgtcgaggataaggtgattaagcaggtaatgattaagaaacttgcgccggaagagaaaaaatgatattataaggtatggattatttttaaaagtagaaaagaggatacaaattatgtcaggacattctaaatttgcgaatatcaagcataagaaagagaaaaatgatgctgcaaagggcaaaatctttacaatgatcggtagagagctcgcagttgcagttaaagagggaggaccggatcctgccaataacttcaagcttgcacaggtagttgccaaggcaaaggccaataatatgccaaacgatacaatcgaaagaggtatcaaaaaggcagcaggagacggcaacagtgtaaactatgagacagctacatatgagggctatggaccatcaggcacagctattatcgtaaagtgtcttacagacaataagaatcgtacagcggccaatgtccgtaatgcctttacaaagggacagggaagcatcggtacacagggctgtgtatcatacatgtttgacgagaagggtcagatcatcatcgacaaggaagagtgcgatatggatgcagatgaccttatgatgcaggcactcgatgcaggcgctgaggattttgccgatgaggatgacagctacgaaatcacaactgcacctgctgattttgatgcagtcaggactgctctggaggaggcaggtatcacaatggcttcagcagaggtcacaatgattccccagacatatgtcacactgacagatgaagctgacatcacgaatatcggccgtatcttagaccttcttgatgatgatgacgacgtccaggaagtataccacaattgggaagagtaaactaaatattatatatcacgggttttagcgggaggagaatatgaaaaagattctatttgtagcttcagagtgtgtaccatttataaaaacaggaggtcttgcagatgtgtgcggtgcacttcctaaagagtttgacaagaactattgggatgtaagggttgtaatacctgattatagctgtataccggagcagtatcgcaataattttgagtatgttacccatttttacatgagctcaggtccatacgtgcaggacaagtatgtcggagtgctcaaatatgagcaggacggcgttacatattactttattgacaatcaggagttctttacaggattttctccatatacttctgacactaagtttgagattgagaagtatacattctttgacaaggctgtactctcaatgctcccgcttattgatttcaagccggatattatacactgccatgactggcagacaggtcttctgcctgtatacttaaagaatgagtttgccgcaaatccattcttctggggtatcaagacaattatcactatccacaatcttaagttccagggaatatgggacagggagtgggtacagggtgtttcaggtcttacagacaatctgttcacaccggacaagcttgagttcaagaaggacgcaaatatgcttaagggtggtcttgtatatgctgactatatcacaactgtcagtgatacatatgcaaacgagattcagacagagtactacggtgagggattaaacggactcttaagtgccagacattttgacatgcagggtatcgtaaacggtattgattacaatgcttatgacccacagactgatggcagaatctattgcaattacaatgcttccgatttcagaaagaagaagttcaacaacaagacaaagcttcagcaggatcttggccttgcggttgacaagaagaagtatatgataggtcttatttcaagacttacagaccagaaaggtcttgaccttatcaatcatgtgattgagggtatcgtggatgatttcacacagcttgttgttatcggtacaggagatcctcagtacgagaatatgttcagacactatgcatggaaataccctgacagagtttcggcaaatatatgttactccgatgatctggctcacaagctctatgcggctgctgatgcattcttgatgccatccagatttgagccttgcggtctgacacagcttatctcattccgctacggtacagttccgattgttcgtgagacaggaggtctcaaggatacggttaagccttacaatgagtatgagaattcaggagatggcttctcgttctcaaactacaatgccgatgagatgcttgcagtcatcaattattctaagcacatcttcttcgataagaagcgtgagtggaaccagattgtggacaggggcatggccaatgatttctcttggaatgcttcgaaattcaaatatgagggattatacaattaccttattggtgaataaaatattttggtgaaattgtggtttttgcataacattttgccccgccattcatggcggggtattttttacctcatttatgattaatcagattactacatgctacgcattcccgtaatctgactccacctcgaaatccgctaatttgctacgtccccgcagcaaattgctactttctcggtgtagtgcgggtcaataaggtatacatcgaattgcatgcaagcatgcatcgatgataccttttgaccctttaatcataaaatcgaaaaattactttagaaaatttacacagaacagaagaaatatgttattatatactctgtaaatcaaaatacggaggttagttacatggcaacgaggaagaaatcctcagcaaaaagacagacaaaaaaggagagaatggctcagatagagaggcagcaggcctttaaaaaggaaatatttctctggatagtagtagctgtttcaatccttttatttataagtaattttggaataggcggtcatttgggaaacgcagtaagcggtttcctttttggtgtatttggaatggtggcatatatttttccgcttgtgcttctggtgggcagcttttttgctgtgtccaataagggcaattcatatgctatcatgaagcttgttatgaccatagttctcatatggtttatatgtgtgtttatgtacctggcagtgtatggtgaattcgcggtttcgccggtgcagtcatatattgacagtgttgaaagacattcaggtggtggctttataggtgctcttataggctgcattttagttccggcggtaggaattataggttcatacgtggtgacaatagttgtgatgattatctgtcttgtgctcattaccggtaaatcattcatgaagggtatgagaaacggcggccgaaaggtatacgagtcagcgcgtgagaataatgagagatatcaggagtatcggcagtataagtcaagagagcgtcagacaagagagggtttagcttcagatgatacagacagtgacataaaggaggctgcaaaaggtggcagaaggagtaagcgtgccggccgaaggatggacaataagataacaggcgtgtcacttgatacaaaaattgatggcagtgaaaacgtgctggattcaggcatggcaggtagtgatacagcccatgttgggatatttggacaaggtgcagcagctacagatgcgcttggtgagataactatagagaattacccgagttcacctgcaataaaggagaaaaagacgacaagccttacatcaggggatgcagggaaaatagtgcaaacaccggactttggtgtggcatcggagcctgtttcggttttgggtggcacagccgatagtgatagtgcagatgagcttggcagaaagaccctgcagcagattaatggcatgaaaccggacggctcgggtgcagcagctgcaagccatgtgtcgcagatacctatatcgggctgcgtggagcctgatatatctgatgattttgacatacaaaaagataatgagctgcaatcaaaattatcagctccggctgcagatgcggtaatgacaaaaccacctgcagcagagccaggtaagaaaaatgtcaaatcagacaaagatgagctttccaaagaggttgaaaaagtcagcgagcagatagcgataaatgacgcagaaaatgcaatccagcagaagccgtatgtatttccggctgttgatctgcttaaggctcctgacaggggtaaaaccggcgattcgcaggctcatctgcgtgagacggcggcaaagcttgaacagactcttaatgtgtttggggtgaatgcgaaggtgaataatataagctgcggtcctgctgttacaaggtttgaaatcacaccggagcttggagtgaaggtatcaaagattgtgaatctggcagatgatataaagcttaatctggcagccgcggatatacgaatcgaggctcctattccgggaaaagccgctgtgggcatcgaagtgccaaacagccagagtgttgctgtttccttcagggagcttgtggagtctgaagaatttaaaaatgccaaatcaaagattacttttgcagtgggaaaagatattgcaggcaaggttaaggttacggatatcgcaaaaatgccacatcttttaattgcaggtgctaccggctcaggtaagtcagtttgtatcaatacaattatcatgagtatactatacaaggcaaagccggatgaggtaaagctgattatgattgacccgaaggtggttgagcttagtgtatacaatggcatacctcatctgatgattccggttgttacagatcctaaaaaagctgcaggagcattaaactgggcggtttcagagatgacagacagatacgagaagtttgcaaacagcggtgtcagggaaataaacggttacaatgccatgattgatgcaatggatggcaaggatacagaaaaaccgccaaagatgccacagattgtcattatagtggacgagcttgcagatcttatgatggttgcatcaaaggatgtagaggaggcaatatgcaggctggcacagcttgcgagagcagccggtatacatctgattatagctacacagaggccttctgttaatgttattacaggtctcatcaaggcgaatatgccaagccgtatcgcatttgcggttacaagcggtgttgacagtcgtaccatacttgatatgaatggtgcggaaaagctccttggaaagggagatatgttatttgacccacagggtgttccgaagccccttcgagtacagggcgcattcgtttcagataaagaagtttccgatattgtgaaatttattattgaaaataatgagaatgcacagtacagtaatgatgtggcacaaaagatggagagcctgtcgaatgatacgacaaatacaaccgttaccatttcagatgtggaaaacacggatgatggaagggactcttactttgcggaggctgcgtcaattatcacagataaggaacgggcttcaatcggaatgcttcaaagataccttaaaattggcttcaacagggcggcccgcatcatggatcagctcgaagaggccggtgtagtgggacctgaggaggggacaaagccccgcaaggttctggtgactaaagaggaattagatactatattagagaataattaacacaaaggagcaaagaaaaatgaaaacagatattcagatcgcacaggaagctacaatgcttccaatcaaggatgtagcagcaactatagggattaaagaggatgacttagagctttatggaaagtataaggcaaagatttctgatgagctcatcaatcgcacaaagaaaaatcctgacggaaagctcatacttgttacagctataaatccgactcctgcaggagagggaaagacaaccacaagcgtaggtcttggagaggcatttggacgccttgggaagaaagcacttatcgcacttcgtgagccgtcacttggaccttgctttggtatcaagggaggagcagccggtggcggatacgcacaggttgtcccaatggaggatttaaatcttcattttacaggagattttcatgcaattacatctgcgaacaatctgcttgcagcacttcttgacaaccatatccagcagggaaacgagcttggcatcgatccgcgccagattgtatggaagagatgtatggatatgaatgaccgtgtccttagaaatatcgttgttggtcttggaagcaagatggacggaatggtcagagaagatcattttgtcatcactgtagcatctgagattatggctatactctgcctggctgatgatatggcagatttaaagaagcgacttggaagaattatcgtggcatacacctttgatggaaagcctgtcacagccgatgatcttcaggctacaggctctatggcagctctcttaaaggatgccttaaagccgaaccttatccagacacttgagcatacaccggcgatagttcacggtggaccttttgccaatatagcacatggctgtaacagtgtccgtgccacaaagacagcattaaagcttgcagactatgttatcactgaggcaggctttggcgcagaccttggcgcggagaagttctttgatatcaagtgccgtatggcagggcttaagccggatgcagttgtacttgttgcaacaatcagagcattaaaatataatggcggcgtgccgaaggatgagctttcatcagagaatcttgatgcacttaaggctggaatcgtaaatcttgagaagcatattgagaatcttcacaagtttggtgtgcctgtagttgtcacattaaattcatttgtcacagacaccaaggctgagactgattttgtagagcagttctgtaaggaaagaggctgtgaatttgcactctcagaggtatgggagaagggtggcgaaggaggaattgaccttgccaacaaggtacttgaaacaatcgagcacaaggaaagcaattttaaggtgctctatgatgatagcctgtcacttaaggaaaagattgaaactgttgcaaaagaaatatatggagcagatggtgttacatattctccggcagcagagagagaacttaagagaattacagaccttggaatgggagatttccctgtatgtatggcaaagacacagtattcgctttctgatgatgctaagaagcttggcagaccgagcggctttaaaatcaacgtacgtgaggtttatgcgtcagcaggtgcaggctttgttgtagcagtaaacggttctattatgactatgccgggactttcaaagaagccggctgcatacggcattgatgtggatgacaatggtgtgatcacaggattattctaggaggaaatatggctaatctaatagacggaaaattaatttcaacacagattaaggatgagcttaaggaagaagtgacagagcttaagaaaaaaggtatcgagggctgccttgcggtgattcaggtcggaaatgaccctgcatcatcagtgtatgttcgcaacaagaaaaaggcgtgtgagtatgtcggaattaaatcgctttcgtatgaacttgcagaggagactacggaggatgagatattaaaacttatcgaaaagctcaatgctgatgcttctgtaaatggtattctctgtcagcttccactgccaaagcatatcgatgaggacaaggttattgatgctatcgacccgaagaaggatgttgacggcttcagtccacagagtgttggagcgatggttataggaaagcctggttttttgccgtgtactccggccggtatcattcagcttttaaagagaagcaatatagatattgatggtaaaagctgtgttgtggttggcagaagtaatatagtcggcaagcctatgtcacttctcatgcttagggagaatgcaactgttacggtatgtcattcacatacaaaggatttaaaagatgtatgtaaaaatgctgatatacttatagtggcaataggaaagcctaagtttatagatgcttcatatgtgaaggatggtgcggttgtcattgatgttggaatccacagaaatgctgaaaataagctgtgtggtgatgtggattttgattctgttgtgtctaaagcgtcacatatcacacctgtaccgggcggtgtaggtcctatgacaattgcgatgctcatgagcaattgtgttgaggctatgaagagataattagacaattagacaataagtaagaggattagatgtatgagatgtgccaattgtggtaatgaattgaaggcgggcagtctgtactgtgatgtctgtgggcatccggttcagatagtgcctgattacaacgaatttgatgattatcttgataatctggttggaaatgatgacaggcgaactgatggacaaaagactgcaaagcctgtgtctgataggacaatcaggtttgatgagccggtgagggaacagcttcatagtgccggtcagtggaacggacaaaaaacggacagaatgtcacagtctgtaaagcagcaagtgagacaggatcagacaggtgagcagcagtctcagacgaaacaaccgtgtgagaagccgcagtctgacggacagagggcaaagagagcgcagcagaagaagataattattatatcagctgtagtgtgcgctgtagcaattgtaatacttattgcagctattacacgtaatgtaagcagatcacatgacaattcatttgattatcaggtgaagcaggcaaaggcagcttattcggcgggaaatataaattccgcggtttcttattatgagaaggctttgtcgattgattcggataatacagatgtcagatttgctttggctgatatatatatgtcgaagaaggattatgatgccgctcttgtgctgtatcaggaaattatcaatattgatccaaagagcaaagaggcttataagcagcttatctcgatttatgaatcaaaaaaggattatgatgcaattgttgcgctgcgtgagagtgctaaggatgcatctgttttaaagctttttgcggattatactgtatctaaaccgcagtttagcaagagcagtggcaagtatggagagactattgagctttctatagatgcagacagcgataccaaaatatactattcatatgattcggatgatcctttgaccagaggagaaagatattatagcccgatcaccctggacaaggaaggtacatatgagataacagctgttgcggttgatgacagaggaatcaaaagcgaggtggcatctgccaagtatgaaatcgagtttgaggcaccggatgcaccggagatagaccctgacggaggtacatttggtgcacagacagacattacaatcacagtacctgaaaattgtaaggtatactatacctgggattcgtcagatccgagtgctgcatcaacagagtatacagctccaatacctgttcctgagggaaataatgtgctttctgttattgcgatagaccagaataccggaaagtgcagtgatatatacagatcaagatttgaattttatatgaattaataaaaaacacgcatgagttgattaatcatgcgtgttctttttaatgaaattatctgttatggctgtaaagcctttattgtatccggattctgtgtggatgtacagtactctttgtttgagacaaaatctgtgaaatacacatactgtgatgttacgtttatgttgcaaaactcacccttagcaagctctttaaagccggtgccgtcattttttacaacacacagtgccggattatcaccgccgcgctgatagaatatcagactgccatatacattgtaatgctcaatattggcttccgttaaaactacaggatttggattgttgatattgacatggacaatcgcattgtcacgatttacatccatgtagtatacatttgtgtcatccagcacaaccggcttgtagcagttgcagtcgtagaataaggcttcactctgtgaagcagtgtcatatctgtatagctgtccgttttttggattattataataaaaataccggtctgatgtgttgcaggtgaacagatagtgactttttattttctttttttcttctccatctattctgatgcggtatagagaggtagctgtttgtgtgtcatagtgcagataatatatgtagttgcctatcagggatgcatagatgcatgggtcaggatccagcacggtggagccgtggccatttctttttatacggcagagactgttcctgtcatatgaaaagaaggtctgacttgtgattttctgattgttgtttcttacgtaatagacatagtttttatctgcgtttatgtacatggctgtgtcattgctcagtttatgtatattgctgccgtcaatattcatggcatacagcctgccgttgtcgtttgtatttgagaaaaatacttcaccgtcactttcacagaagagcccggcattgtacagattacctgcagtattaccatttacataggatgaattaagctttacctttgatacaaaatggtatataacaaggcctgtgatgcatattaaaattagtggaataattatttttagatattttttcatgtaattctcccgagggtatttgatatttatgcttagatattaactaaattatatctatatatgataaatctttcaaggattacttgcctttctataaaatttgtaataatattttattatatcttttttaggagacaataatggaagatttaatgaaattgagagagtctatcgatgagatagacagtgaaatagtcagattatataaggaaagaatggatatctcaaagcacgttgccgagtataagataaccaccggcaaaaaggtctttgacaagacgagagaggatgaaaagcttgagaaattatcgtctcttgcagatgatgagtttttgaagcatggtatagttgagctttttgaacagattatgtcgaccagtagaaagaagcagtatcagcttatgactgagcatggcatagtggagaaggaaaactttactgaggtagacagcctggatttttccaatgcacggattgtgtttcagggagttgagggtgcatattcacagcttgccatgaagacatactttggcgagaactgtaatggctacaacgtggattcctggaaggatgccatggaggatatcaaatgcggaaaggctgattatgcagtgcttccgatagagaattcttcagccggtattgtatctgaaaactatgatctgcttgttgaatacgacaattatatagttggggagcagattatacgcatcgaccacagtctgatgggacttccgggtgcaaagatttctgatataaggactgtgtattcacatccacaggcgcttatgcagtgctcagatttttttgatgagcataaggatattaaccaggtggctgtcaggaatacagctttttctgcaaagaaggtaaaggatgacggagatatcacacaggctggcatagctagccatatctcggctgatatatacgggcttcaggtgcttgagagccgcatacagaacaataaaaacaatgcaacaaggtttataattgtgtcggctaaaagggtatgccgcagagatgcggacaggataagcatatgctttgagacacctcacaagagtggtgcactatatcatatgctggcacactttatatacaatggaatcaatatgttaaatatccagtctcgtccgatatctgataaggcgtgggagtacaggttctttgttgattttgaaggacgttttacagatacagcggtgcagaatgcgttaagaggcataagggaagaggcaattgcccttaagattcttggtacatattagattatagaaatttagataaaagtgttgacaacagaaattgtctgtgctatattctagtagttgtatgaaaacaaagtagagtatccactctcacctaagcgcaatggcgcgacttagcgttaatattttcaaacatttgtgttgaagattgtatagtggatagtctgcctatccactattttttatggaggtacaagaccattagcgaattaatgattaatgaacagatcagagacagagaagttcgactgattggagcggatggagagcagttaggaattgtttcttcaagagaagctcaaaagattgcagacgaggcaggacttgatttagtaaagatagcaccaaatgcaaagccacctgtatgtaaggtgattgattatggtaagtatcgttatgagcaggcccgtaaggaaaaggatgcaaagaaaaagcagaagaccgttgaattgaaagagattcgtctctcacctaacattgaggctaacgacttgaataccaagatgaatgctgcaaagaaatttcttgcaaaaggaaataaggtaaagatcacactcagattcagaggacgtgagatggctcatatgaatgcaagcaaacatatccttgatgatatagcggagaatctttcagatgtagcggtagtggagaaagcaccaaaggttgaaggaagaagcatcggtatggtgctggcagaaaagagataacaatttaaggaggaacacacaatgccaaaaatgaaaacaagcagagcagctgcaaaacgtttcaaagttacaggaacaggaaagttaaaaagaaataaagcctacaagagacatatcttaactaagaaaacaacaaagacaaagagaaatctcagaaaagcaacaatgacagatgagacaaatgttaagaatatgaagaagattttaccatacatgtaatcggtagtattagttaaggaggaatcaacaaatggcaagagttaaaggcggtttaggcgctaagaaaagacataacagaacattaaagttagcaaagggttatagaggcgctagatctaagcagtatagagtagcaaagcagtcagttatgagagcacttacaagctcatacgctggacgtaaagagagaaagagacagttccgtcagttatggattgctcgtatcaacgcagcagctcgtctcaacggactttcatacagccagttcatgcacggcttaaagttagcaaacgttgaccttaaccgtaaggtattagctgatatggctgttacagatgcagcaggatttgctaaattagtagaggttgctaaatctaagcttgcttagtttagcataaagagatatatgaaaaagctgccgggcttcatgtgaagcccggtagcttttttttattcttgagcttttttgtatttactgcgatactccttaggcgaaaggccttttattttatgaaaggtctttgaaaaataaaggctgttatcaaaccctatagagcctgcaattgctgtgatggacaatgaggagtgtttaagcagatagcatgcctgtttgattctgaaatcggtcagatattcctttggcgatacaccgaggatgctctggaaggaacggaacaggtgacttcggcttaagcctatatatgatgcaatatcctcaacggtgatagggtatgaatagttggcggagatgtattcgatgcccttttgtacataggagtttgcactgttttgcggcggctttgatgtggcggcactgacaaaaagagcgagggtggtgtagagtcgcccggtcatttcgagtgcattttcaaattctgtgcctctggcgtcgtatatatgcatgagctgtcttttgatttcgtttccgtttgatacactgtgtatgtatggatgcgcttttgtgaaatcagtggctcttaaaatggttgcagcatcgctgccggtaaagcctacccaggtatattcccaaggatcttgcgcatcagcctgataaatcacctcggtatttggatatacgagaaacgcatcaccgggagttaatgtgtgaacactgccatttacagtgtagcggcctttaccgcttatgatatagtgaatcagataatggtctctgataccgggtccccactgatacaggctatcacagctctggaagcctacgttatatacggacagagatacaagctctttttcttttacgatataggaatttttgtatttattgttcatattgcctacctttacaacatttttacatatttcttctacattttattctatacaaaaatgagcaaatgcgctacaataaatttaacaaaaatgaaaaggagatatttattatggcaattttagttactggtggagccggatatatcggaagccacacatgtgtggagcttcttgatgcaggctacgatgttgtagtacttgacaatctttcaaattcttctgagaagtcacttgacagagttaaggctcttacaggcaaagaagtaaagttctataagggagatatccttgacagagacatcttaaataagatttttaaggaagaaaagatagatagctgtattcactttgcaggactcaaagcagtaggagagtctgtggcaaagccttgggagtactataacaataatattgcaggaacacttacacttgttgatgtgatgagacagaatggctgcaagagcatcattttctcttcatcagctacagtatacggagatcctgcacagattcctatcacagaggagtgtccaaagggacagtgtacaaacccatacggctggacaaagtctatgcttgagcagatacttatggacatctataaggcagataatgagtggaacgttattcttcttcgttacttcaatccaatcggagctcataagagtggtacaatgggtgagaatccaaatggtattccaaacaacctcatgccttacatcacacaggtggcagtaggcaagctcaaagagcttggagtattcggagatgactatgatactcctgacggaacaggtgtgagagattacatccatgtagttgaccttgcggttggacatgtcaaggctttaaagaaaattgaggagaatgcaggtctttgcatctacaatcttggaacaggacacggctacagcgtgcttgatatcgtaaagaatttcgaggctgcaacaggtgttaagattccttatacaataaagcctagaagacctggcgatattgctacatgctactgtgacccatcaaaggccaagagagagctcggctgggaagcacagtatggtattaaggagatgtgtgccgactcatggagatggcagaagaacaatcctaacggatatgatgactaattatcagaaatattggcgcccggagtacactctgtgacacgcaatacctcgcatgcgctaacgctttgcagttaagatgctgtatgaattatgcatatagaatttcacagaatgacgaaaccggcttttacgcaccgtccgtggtgcgtaacgccttgccccaccgtccatggtggggcatttctatttgtgaagcataattctacagcatctaaacagcgtagcgttagcgcatgcaaggtgcatttcggtgctgcgggtgcgtccggtgtaaaaacaataaaaaaacatcgcataaatgcgatgctttcgggttgggctgtatttaattaaataaatatcagtgagcagtccgtacgggaatcgaacccgtgtttccgccgtgagagggcggcgtcttaaccgcttgaccaacgaaccgtgtattatactatcatggagtttcaaaaaaagcaagtacttttttaaaaaaacttgattttttttcctgatagtgctattatacctatgataacaacgttgactagattgagagagggcaaaagtcctctctcaattcacgtttataaacatcaggcagctattcagaaccacttggaacaattatgaatagttacaagtataaaaaagagaggtgataaaatgtcaaaggcaagtgtatatgaggcaaagacagagagctttatacaaccaattcttgacagcatgaattttgagcttgttgatgtcgagtatgttaaggaaggcggcatgaactacctgagagcatatatcgataaggagggtggcataactgttgatgactgtgaagtggttgcaaggcagatgaatgagattctcgacagagaggactatattcctgattcgtacaccttcgaggtcagctcgccggggcttggaagacctctcaagaaggaaaaggactatgtgcgcaatatgaataaggagatagagattcgcacatacagggctatcaacaaatcaaaggaattttatggtctgcttaaagcctatgataaggatacagtgacaataaccgatgaagacggcaatgagactacattcaataagagtgacattgcgcttatacgtcaggcattggatttttaattaaagcgcacgataacacaaataggaggaaaaaataatgagcaatgagttattagaagcgttaaatatattagagcaggagaaaaacatcagtaaagaaactttacttgaggcaattgagaactctcttgtgactgcctgcaagaaccattttggtaaatcagacaatgtaaaggtagaaatagatcctgagacatgtgctttctcatgctaccaggagaagacggttgtagatacggttgaggatccggttgaggagatttccttagcagatgcgcacaaggtaaacggtaactatcagcttggagatatcgtgagagttgaggttaagtcaaaggaattcggacgtatcgctacacagaacgcaaagaatgtcatccttcagaaaatccgcgaggaggagagaaaggtaatatttgacgagtacaacagcaaggaaaaggatgttgtgacaggtgttgttcaaagatacatcggaaagaatgtcagcatcaacttaggtaaggcagatgcacttctgactgagagtgagcagataaagggtgaggtattcaagcctacagagcgtatcaaggtatatatccttgaggttaagtccacatcaaaggggccaaagattcttgtttcaagaacacaccctgagcttgtgaagagacttttcgagtcagaggttacagaggttaaagagggcatagttgagataaaggctatttcacgtgaggccggaagcagaacaaagattgcagtatggtcaaatgatccaaacgtagaccctgtaggagcatgtgtaggtatgaatggtgccagagtaaatgctatcgtaaatgagcttcgcggtgagaaaatcgatatcatcacatgggatgagaatccggcaatacttatccagaacgcacttagccctgcaaaggttatctctgttatcgcagatgcagatgagaaatcagcaaaggttgttgttccggattatcagctttcgcttgcaatcggtaaggaaggacagaatgcaagacttgcagcaagacttacaggcttcaagattgatatcaagagcgagacacaggccagagagtcaggggacttcatggattatgagaatgactatgaagaggatgattatgatgacgattatgattattcggatgatgagcttgctgagaacgagagattagctgatacagaacaggcagatgtacaggcagaggcttttgatacagaggctgacgagaacggagcagcaggtacagaaaatgatgcggcagatagtggtgatgagcagtaatggcaaataaaaagattccaatgcgcaaatgcgtaggttgtcaggagatgaaggaaaagaagtcacttattcgcgtggtaaagactgcggagggcgacataattctcgatgacaccggcaagaaaaacggcaggggagcttatatatgtaagagtcttgaatgctttaaaaaggctaaaaagacaaaggcacttgagcgatcccttggcgttagtgtatcagaacaggtatatgaggagcttgaaaaggagatgaaccaaattgacagatagagtactttctatgctgggcttagcagcaaagtcaggcaatgtggttagcggagagttttctacagagaaagctgtaaagacaggaaaggcatttttagtgatagttgcagatgattcatcagacaacacaaagaagcatttttcggatatgactgctttctatgaggttccgatttatttttatagtgacaaggtggggttagggaatgcaataggcaaagagtttcgcgcttcccttgcagtaacggatgaaaaccttgcaaatgcagtgataaaaaagctgcagtcgaataaaactgaataatggaggaaaatagatatatggcaaaaatgagagttcatgaacttgcaaaagaattaaatataaagtcgcaggaagtcatagacacattaaacggcacacagtttgctgtcaaaaatgtgcagagcggtcttgaggatgaggcacagcaaattgtacgaaagaagtacgcaaaaacagaagtaaaaaaagatgcacctaagaaggaagagcctaaaaaggatgaggctaaggcagccgacagaccaaagaaaaaggcaagcatcacagcagttttcaatgcccagtacagtaagcagggtaggaaaacaaatggtggaaacggcagcggaaataatggaaataacagttcgcagcgcaggaatggcaatggaagacgcgataatcagtcatcacgtcctgagcagcacagcattattaagccaagacctgtcggagagagagctatgcgccctataagtgagcgtacagcggatccgtatgcagatatgaaggcagccaattcgcgtccggcacgtcaggctgacgctgatagaagaagcgacagacgtcaggacaatggcgagaaaatcaacaacagaaacactgacagaaatgccgacagaagcagaaatacggacagaaacagcgatagaagaacaaacaatcgcgacaacaataaccgagataacagcagagacaataatagagacaataaccgaggcttcagaaatgacgccagacgtcctgcagagggcggcagaagctttgacagaaataatgacagaagcagaagcaatgacagaagcagaagcaatgacagaaataacgatagaacaggcagcagaggtgatgacagaaatcgtttcagaaaagaaacagttgcagttgcagctcctgatgatgtaagaggaaaggagagccgcgacagaggcaacgatagaaagaataagcataatcacaatcagagccagaagcaggataagctcggaaagaagcaggagaattacatcaatctcgagaagcatggcggaaagaaaaagccacagcagccgaaggcacagccaaaagaggatgagaacgagattaagacaatttctcttccggagaagattacaataagggacttagctgataagatgaaggttcagccttcagccatcgtaaagaagcttttcatgaagggcgagatggtaacagttaactctgaggttgattttgcagctgccgaggagattgctttagagttcaatttcatatgtgaggaagaggagaaagtcgatgtgattgcagagcttctcaaggaggatgaagaggatgagagcaagatggttcctcgtccacctgtagtctgcgtaatgggtcacgtagatcatggtaagacatcactgcttgatgccatcagacagacacgtgttacagaccgtgaggcaggtggtatcacacagcacatcggtgcatctgttgtatcaatcaatggccagaacatcacattccttgatacaccgggacatgaggcatttacagcaatgcgtatgcgtggtgcaaactctactgatatcgcaatccttgttgttgctgcagatgatggtgtaatgccacagactgttgaggcaataaaccatgcaaaggcagccggtgtagagattatcgttgcagtcaacaagatagataagccaagtgccaatatcgacaaggttaagcaggagctctcagagtatgagcttatcccggaggattggggcggaagcacaatattctgtcctgtatctgcacatactaaggagggtatcgacaatctccttgagatgattcttctcacagcagaggttctcgagctcaaggctaatccggacagaaatgcaagaggtctcgtaatcgaggcgcagcttgacaagggccgtggtgcggttgccacagtgcttgtacaaaaaggaacactccatgtcggagatcctatcgcatgcggaagcagctatggtaaggtaagagccatgattgatgacaagggccgcagagtaaaggaggctaagccttctacacctgtagagatacttggactcaacagtgtgccttcagcaggagagacatttgtggcatgcgattcagagaaggaggcaaaggcattctctgacacatatatttcagaggagaagaataagctcatcgaggatacaaaggcaaagatgtcacttgatgatctgttctcacagattcagtcaggcaacatgaaggagcttgatatcatcgtaaaggcagatgtacagggttcagttgaagctgttaagcagagtcttgtcaagctttcaaatgaggaggttgtggtcaaggtcatccatggcggcgttggtgccatcaacgagtcagatgttatccttgcatcagcatcaaatgcaatcatcattggctttaacgtcagaccggatcctgttgccaaggctacagcagaccgtgagggcgtagatatcagactttacaaggtcatctacaatgcaatcgaggatgtatctgctgccatgaagggtatgcttgatcctgtatttgaggagaaggttatcggacatgcggaaatcagacagattttcaaggcttcaggcgttggaaacattgcaggttcatatgtgcttgacggatttatggagagaggctgccgtgtcagaattagcagagagggtgagcagatattcgagggagaccttgcttcactcaagagattcaaggatgacgtcaaggaggtcaagacaggctatgagtgtggtcttgtatttgacggatttaatgatattcaggaattcgatatagttgaagcttacaagatggtagaggttccgagataatcatatattggttatcttgaattaatgcagctattcggatagttacggtttaatataaaaagaaagcgggattatatgagaaagaacagcataaaaaatattcgtatcaacgaagaggtaatgcgtgaactgtcaaatatcatacgcggtgagataaaggatccgcgtatcaatcccatgacaagtgttgttgctgtcgaggtggcacctgatttaaagacagcaaaggcttatatcagtgtgcttggtgacaagaaatcacaggctgatacacttgcaggacttaagtcagcggagggatatatacgcagaactctcgcaaagaacatcaatttaagaaatacacctgccattacatttatcatagaccagtctatagagtatggtgttgagatgtctaaaaagattgatgaagtaacaaaaaatctcaaagaggattaacaaagaggattgattatgacagagattgattctattttaaaggatgcacaatcagttgccgtttccggtcatgtgagaccggacggcgactgtgtcggctcaacacttgcggtatacaactacataaaggattattatcctgatataaaggcaaggctttatttagagccaagcccaaacatctttaagtttatgcagagagcagatgagattgacagcagctatgcggatgatacagtatacgatctgttcatagcatgtgactgcagtgacacaggcagactgggaagtgcagctaagtattttgagtctgcaaaaaggacactttgcatagatcatcatgttacaaacggggcctttgcagacgcaaattacatctttccggatgcgagctcaacctgtgagcttgtgtttgaacttctgccgaaggagcgcatcacaatacagatagcagagtgtatttacacaggcatggtgcatgatacaggcgtgttccagtattcatgcacttcaaaaaagactatggatatagcaggctccctgatggagatgggcattgattattcaaggataatcgatgatacattttatacaaagacatttgctcagaacaagattatggggcaggcacttttgaatgctgctttgtatctgaatggtgatgttatattgtctgcagtatcgcgcgctgagatggagaagtacgatgtgcttccaaagcatctcgacggcattgtaaatcagctgcgcgtgacaaaggatataaaggttgctgtatttctctacgaaaatgaggatggtacctacaagggcagcctgcgcgtaaacggtgattacgatgtggcaaaggttgcgtcggtatttggcggcggtggacatgtaaaggccgccggatttacgattgacggaccgcttgaggtggcaacagaccgcatccttacggcaattaaggacaatatttagggagagattcttgggcagatggttaatggaataatcaatgtatacaaggaaaagggctatacaagctttgacgttgtggcaaagcttcgaggcatattccaccagaagaagattggtcatacaggtacacttgatcctgatgcgcaaggcgtccttcctgtctgccttggaaaggcaaccagagtgtgtgaccttttgacagataaggacaaggtctataaagcggtgctgcttttaggacaggagacagatacacaggatatttcagggcaggtcttaaatcaggctaaggtcaatgtgactgagcaggcggtgtatgatgcaatatcacagtttattggcagacaaaagcaggtgccgccaatgtattcggctataaaggtcaatgggaaaaagctctatgagcttgccagggagggcaaggttatagagagaaaagcccgggatatcgaggtgtttgatatcaaggttgaaagcattgatttgcctgaggttacgatgacggtgcactgttcaaagggcacatatatcaggacgctgtgcaatgacatcggagagaggctgggctgccatggctgcatgaagtcactgcttagagtaagggtagcaggctttgacttagagcatgcacttacactttcgcagattcagtcgaaggtggatgaaggcagccttgatatggtgcggcctgttgatggagtgtttgaaaatctgccggcagtgcatactgtggcagaggctgataagcttgtcagaaatggaaataagcttccggcagtgcttacggattatttaaaacacggtgctgactctgatataagatacagagtatacaatcatgagggcatatttgtcggggtgtattcgtatattgatgagaccggtgagtttaagccggttaagatttttatggaatagaatagtatacagatattatggaatatataagcaaaactctggattttcatgtcaaggagccgtccgtcatctcgtttggaaagtttgacgggcttcaccgaggacatgaatttctgatggaaaagcaaattgaacagagcaatctgcatggctacaagcgcatcatatttacgtttgacattcctcccaaatcggaggtacttggcgttgagtcaaaggttataatcacaaacgatgaaaaagagtatgtgtttgaaaaatcaggtattgactatctgatagagtgtccgtttgtgccacaggtgatgacgatggaggcggatgcgtttgtcagatggatagttaaaagtcttaatgtcaagtgtatcattgtcggagatgatttccgtttcgggcacaacagggcaggagaccatcggctgctttctgcgatggcaggagagcttggatacgagcttattgtggtggacaagataaaggatggagacagggatataagcagtacctatatccgcgaggagattgcggcaggacatattaaaaaggcgaatgaactgctgggatatccctttttcataaaaggaagagtagtgcatggcagagcactgggcaggactattggcattccgacagtcaacctttcagtgccgcacgataagctgcttccaccaaagggagtgtatatgtcaagagttcttgtcagggacaactggtaccttggtgtaaccaatataggatgcaagcctactatagagggcaaaaatccaatcggtgcagagacatatatcatagattttgggcaggatgtttacggacaggatatcatggtagagcttcataagttcgtaagacctgagatgaagtttgattcaatagaagcgttaaagagccagatgagtgcagatatcaattatacaatcaattatgcaggcagtcacacattctagtgtggctgtttttttgcgaaattacccaaaataacgaaaaaatgacaaatattacggaaatattacggaaaaatattgacattttaacaatttgtgatatactcgtaaacatgggattatggatagcatgaactggaggctatatgaaaaataaattaaaattaggacaggcagcaggcgttgtagcgtttgctattattataggtgctgtatctatgagttcaagcagcacagtagatgccagagcatcattaaaggaaaacagaacagtcaatgcgggggtggctcttggtctgacagaggcggcagatgctacggagcttcttacagcaggggttacatcggctcttacttattatggagctgacgtatcggtagcgcaaaacgacagcaatgttgttactgcatctgctcagggtgcacaggttggcaatactgcacaggagacagaacaggcaaatgaggcatcccagacaccgacagccgcacagacctgtggttacacaaatcttggtatgtcggttatcagcagcggaaacttaaatatcagacaggaagcttcgacagacagcgaggtaataggaatacttaccaatcacaatgcctgtgagcttcttgaggatgccggagaatggtacaaggtcacatcaggcaaggtgacaggatatgtaaacaagcagtatcttgtaacaggagatgaggcagaggctattgcagaacaggagattaagacggttgccacagtaaatacggaaacactgaatgtgcgtgcagagaagtcaacagaggctgcggtgctttcgcaggttggaaattcagaggcattcacggttaattctgtcgctgacggctgggttgagataagtgtggatgattcggtaggatatatatcacaggattatgtgacactggcacaggcacttcctacagcaaagacaattgagcaggtgaagtatggtgacggcgtatcagatgtaagggcatctgttgtatcgtatgcgttacagtttgtcggaaacagatatgtgtggggtggtacaagccttgagaagggaattgactgctcaggcttcacaatgagaattcttggaaagtatggaatctcattaccgcattcatcaagagcacagccttcatacggcacaaaaatcagtgcatctgaagcaaagccgggagatttattcttctatggaagtggaaggagtatctcacatgttgcaatttatatcggaaacggacagattgtacatgccagcaacaagcgtgatggaatcaaggtttcaaatgcatattacagaaatccgatttgtgtcgcaagatatttgccggattaataaaaaaacagtttacaacaaatgcttactatgctatactgcataagtgtggttttgcccatgttcggtagttggacactccgacctattgctgagcatcatacagttatcagggcgcattataatataaggaggatcaacaatgatcgcaaaggaaaagaaacaggctattatcgcagagtacggtagaacaccaaatgacacaggttcaccagaggttcagattgcaattctttcagcaagaatcgcagagttaactgagcatttcaaacagaacccaaaggatcatcactcaagaagaggaatgttaaagatgatcggtcagagacgtggattacttgcataccttaaggagattgatatcgagagatatcgttcacttatcgagcgtttaggactcagaaaatagtattttctttagagcggagtaattattattccgctctattattgtttttattattgttttttgaaaagcagaagtaagccgagaccactaaagagtgcatgagcatacatgtattgtttagtagtttcggaagaggaatacacttctgcaaaagaatttttaaggagaattaatatgtacaaaagttattcaatggaacttgccggcaggactcttactgtagatatcggaagagtagcagctcaggcaaacggagctgtttttatcaagtatggtgatacaacagtcatttcaacagctacagcatctgacaagccacgtgacggtgtggatttcttcccactcagcgttgagttcgaggagaagatgtactctgtaggaaaaattccaggtggttttaacaagcgtgagggaaaggcatctgagaacgccatccttacagatcgtgtaattgaccgtcctatgagacctcttttcccaaaggattacagaaatgatgttacattaaacaaccttgtcatgtcagtggatcctgagtgccgtcctgagatagttgcaatgatcggtacagctcttgctgttcatatatcagatattccgtttgacggaccatgtgccatgacacagatgggacttgttgatggagagtttatcgtaaacccttcacagaagcagtgggatgagggcgatttacagctcacagttgcttctacaaaggaaaaggtcatcatgattgaagcaggagccaatgagattcctgaggatcagatgattgaggcaatctacaagtgccacgatatcaaccagacagttatcgcattcatggatcagatccgtgatgagattggcaagccaaagcatgagtatgagagctgtgctattcctgagcagatgttcgaggatatcaagaaaattgttactcctgagcagatggaggaggcagtattcacagatgagaagcagaagcgtgaggaaaatataagagctatcacagagcagttagaggaagcattcgctgacaatgaggagtaccttgcagtacttggtgaggctatttaccagtatcagaagaagacagtcagaaagatgattttaaaggatcataagcgtccggacggccgtgcaatcaaccagatcagaccactcgcagcagaggttgatttgattcctagagttcacggctctgcaatgtttacccgtggacagacacagatttgtgatgttgtaacgcttgctcctttatcagagattcagaaaatcgacggacttgatgcaaatatcacaacaaagagatatatgcatcactataacttccctgcatactctgtaggagagacaaaggtatcacgtggaccgggacgtcgtgagattggacacggagcacttgctgagaaggcacttgttcctgtacttccaagcattgaggagttcccatatactatccgtgccgtatctgagacatttgagtcaaacggctctacatcaatggcttcaacatgtgcatcatgtatgtcacttatggctgcaggtgttccgattaaggctatggttgccggaatctcatgcggacttgtaacaggcgatacagatgatgatttccttgtacttacagatatccagggtcttgaggatttcttcggagatatggatttcaaggtaacaggtacacataagggtatcacagctatccagatggatatcaagattcacggacttacaagacctatcgttgaggaggcaatcgcaagaacacgtgaggcacgtctctacatcatggatgaggttatgagcaaggcaatcgctgagcctagaaaagaagtaaatgagtgggctccaaagattgagcagattacaatcgatccatcaaagattggtgatgttgtcggacagaagggtaagacaatcaatgagattatcgatagaaccggtgtcaagatcgatatcacagatgatggcgctgtttcagtttgcggaacagataaagagatgattgcaaaggcaatcgacatgattaagattatcacaactgattttgagcagggacagatccttgagggaacagttgtaagcatcaaggagttcggtgctttcatcgaatttgctcctggcaaagagggaatggttcacatttctaagattgcaaaagagagaatcaacagagtagaggatgtactcacacttggagacaaggtaaaggttgtttgccttggcaaggacaagatgggaagaatcagcttctctatgaaggatgtaaaagaggattaattaatatacgttaaagtataacaataatatctaagtaaagggctgcacgcaggtgcagtccttttaatatatgaaattatagtaaggtgatatgatgtaaggcaaaacaggtgcgtctgtgtcatattgtgaaaacgaatcatatactaaattaaaaaataaaataataatgaaaaatgcgaaatatagtataaatgcaaatctggtatataaaaatggatatagtggtaaaaatgtcaatatagcagtgcttgatacgggtgtgtttaaacacaaacagcttgatgggtgcataaagcactttatggattttgtgggtggaaaggagacatgttatgacgataacgggcatggtacacatgtgtgcggtatattatcggctgcagatataggcatggctccgggggcaggactatatgtgtttaaggtgcttgattatcttggcatggggcagacgtcggattcaattcgtgcacttaagtatataaaagaaaactgtgtcagacttaatataaaaatactcaacttctctgtaggatatctgccatgttctgatacagcagagcgtattaagatattgaagctgatagatgaattgtgggatatgggagtagtagttgttgcagcagcgggcaactatggcccggcaccgttttctgtaactgtgccgggaatttcaagaaaaataataacagtcggaagctttgatgatataagaagtggcaaaggtcctaccgactgttgtattgtaaagcctgagattctggctcccgggcatgatatcataagccttggaacgagagatggcacatatgtaaggaaaacaggtacttcaatggctacaccgattgtgtcaggtgccatagcacttctattggaaaaaaatccaaatatgagaccggaggcggttaagctagcactgtataatacatgtgacagggcaggggatagtcacaaaggctcgtgggggattataaatgttgataaattggtgggaatattataatatgtattagagatttattatagataatataggaaatattaggttgtataattgtaatttcatggtagggcttatatgagaaaaatattacaaagactgctttcaaagctttttatagtttcgacaataataatcatacagatgatatggtggttctttttgttttatacggcctctgttgccagcagggtgtttcaggatctgatgtatgtggcagctatattgctttcgctttatattgtcaacaggcggatgaaaatgtatataaaaatgtcatggatatttttgatactgagtgttccaatcgttggtattccgtgctatttctttttcggaagaccggagcttacgtcgaagacacagaaaagaatggcgagaattgtggaagcatatgcgccgcttcggcctgaaaacgagctgctaaatgagacactcagacagacagatatggatgcatacagacaaagcaggcttatcactcaaaatcagaaatatccactgtatgcggaggactgcacagagtactttaaatcaggtgaggaggcttttgagagcattttaaaagatttaaggtcagctgaaaagtttatctttatggagtatttcataatcggcagtggcgttatgcttgatcagatacttgatatactcaaagaaaaggtaaagcatggagttgtggtgagaatcatatatgatgattttggcagcataaatgccattccgccacattttataaaggcgatggagagcatcggaatacagaccagacgcttcaatccatataagcccatgctttcagtaattatgaatgacagggatcataggaagatactggtgatagacggacgtgtggcgcataccggtggttacaatatagcagatgagtatatcaacaaaaaaatcaggtttggttactggaaggatgccggtatccgtgtggagggagagtgtgtaaacagtttcacgacgatgttccttgagatgtggaattatatcaataaggacaatgctgtgcatgatgaatatctgaatccacacaatactttcagccagtcagaggaaagcggttttgtccagccgttttgcgattcaccgcttgagcatgatgatgtaggagagaatctttatgtgagtatcatctcaagagctaaaaaatatgtttatatttttacaccgtatctgatacttggaacggagctgtcgcatgctatgatatcggcagccaggtcaggtgttgatgtgcgtattgttgtacctaagattcccgataaaaagctcatttatctgcagacaaaagccaatttcagacctcttatcgaggcgggggtaaggatatatctgtacacacccggctttatacattcaaagtgtatagtggcagatgatgatactgcgatagttggcacatgcaatctggatttcaggagcatgtactggaattttgaggattttgtatacatgtacaggactcagtgcatcggaaaaataaaagaggatgcgatagagacgtttgcggtttcagaggaggtgtatgaggaaagcacaaatgatatctcatttgcaggcaggctgctgcagagtattttgcagctttttgcaccgcttttgtaaatgtgtctgtaaagcgtctgataaaaatctgttgaataatgttacaagttgtaatataataatccaagcgattgcgtaagcaacgcacgaagaaactgaatatgtagcataaaggtgtcggagcagacaagcatttgaatctgatttatgacaggcgatgtgaagctggctccggtgaaaagggaaacaggtgcaaatcctgtacgaactcgtcaccgtaattaaggagtgacggccaataagtcactgggcaaccgggaagacggccgaagcaatgatatataagtcgggatacctgcctttgtgttgtacggaaacaatagtgtttcaagccacgagtaactggctgtacgtgatgaaataattataattacagacaaggttatgatagccgtatagtctgggttagaaggattttgacatgtatagctctttgacataatagtacaaagagcttttatttttgacgctttaaatgttttcgtcttacatatttaaaacatgtgcagcttaatagctgcaaggagaatgaaaaggagaaaacatgaaaaagaaattagtagtagtactgatggcagcagttatggctatgacagcagtgaccggctgtggcagcaaggcagatgatgcaaagaatgatacacaggcatctaagacttcagagagtgagacaagcgcaaacgcggatcaggaggcagcaatgcatgtggcagatttaatcgatgcaatctacgtgcaggagagaacagatgatacagacaagcagtgcaaggaggctaaggaggcctgggacaagctcacagacgcacagaaggagcttgtagagggagaaaatgctgatcctgactatttcggcagagatacaggcgatgcttcaaaggatgatccgagaaaccaggatgatatcggcgagaacgagattcttgtagtaagctttggtacatccttcaacgacagccgtgtggctgatatcaagggtgtggaggatgcaatagcagctgcaaatcctgactggtcagtcagaagagccttcacagcacagattatcatcaatcatgtacaggcaagagatgacgagaagattgacaatatggatcaggcacttgagcgtgcagtcaaaaatggtgtaaagaatcttgtggtacagcctacacacctgatgcatggcgcagagtatgatgagctttcagaggctgtagaaaagtataaggataaatttgagtctgtaaagattgcagagccactcctcggtgaggttggaagtgatgcaacagttgtaaatgaggataaaaaggccgttgcagaaattcttacagaggaagcagtagaaaaggcaggctatgacagccttgatgctgcaaaggaagagggcacagcatttgtatttatgggacatggaacaagccatacagcaaagatttcatacagccagatgcagagccagatgacagctttgggttatgagaacgtatttatcggaactgtagagggtgagccggaggatacatcatgtgagtctgtcattgagaaggtgtcagccgctggctacaagaacgtcattcttcgtccgcttatggttgttgcaggagaccatgccaacaatgatatggcaggaagtgatgatgattcatggctttcacagtttaaggcatcaggaaagtttgataaaatcgatacacagattaacggacttggtgagattgagggtatccagaagctttatgttgagcatacagcggctgctatgagcaagtagcagttacttaaatgtatagtggggaagctataaaataacaggagcagtatatcagacatgagaaaattattcagaaacaagtttacttatatcgttgcaatgacactggtttgtgccatgagcttggcagcctgcggcaataagaatgcaaaagctgaaacagaaagcaaaaaagcagtgcaggatgcgacagagagcacaaaaaaggctgaaaaaacagaaaagatagcactttcagatggtacatatacagcagagtttactacagacagctcaatgtttcatgtgaatgatgcatacgacaacaaaggtacactcaccgtgaaggatggcaaggcaacaatacatgttactctcacatccacacacattgtcaatctctttttgggaacagcaaaggatgcctcaaaggacaaggctgagcttttagagccaactgtagagactgtcgattatggcgatggcacaactgaggaggtcaatgcgtttgatataccggttcctgttttggatgaggaatttgaccttgcacttatcggtacaaagggcaaatggtatgaccacaaggtaaaggtctcaaatgccacacctgcggacgcagatgcaagcgtatctgagagtgcaggaaaagagcttcctgacggaacatacaatatcaatcttgatttcgagggcggaagcggtaaggcgagcattgcatcaccggctgaggtgactataagcggtggagccgctactgcaacagtgcagtggagcagtccaaactatgactatatgatagttgacggacagaaatacatgcctgtaaatacagacggcaattctgtatttgaaattccggttaagcttgatacacctatgcaggttatcggagatacagttgctatgagcaagccgcacgaggttgagtacacactcaccttccattcagattctgctacagaggtgcttggtgaggatggagaataattaagctatgcatggaagaaaaaagataattatatatatattgatatcaattataggactgttctggctgtcaggctgcgacagtccttcttccgattcagggaataccgaatcgaaggctgaggcagaggtacaaaacggtcttatatataagagcagtatgaagcttttatatgcaaagaatttttctgttgactattatgagggtggatacaagatacttacgacaaaggacggtaccaaaatacttaccgtgccaaagggcagaaagactccaaaggatattgacaaggatatcattgtattgaaggagcctgtaagtgatttgtatctggtcgcatcaggtgtgatggatatgtttgacaagcttgatgcagtggacactattaaattttcggggcttgacagtgatggctggtacattgacagtgcaagaaaggctcttgaaagtggcagaatgctatatgccggcaaatactcaaaacccgattatgagcttttggtgtcagaaaactgttctcttgccatagaaaatactatgattactcattcaccgcaggtaacggaaaagcttaaaagctttgatatcccttcaataatcgagtactcaagctatgaggaggagccgctcggcagagtggagtgggtgaagtttttcggagcactcacagacagggatgaaaaggccgatgagctctttaatgagcaggtggatattgtaaatcgcatcgcaaagacagatactgctgcaaatgatgatagcagaccgacagttgcatttttctatatcacatccaatggacaggttcaggtgcgcaaaagtacagattatgtgccaaagatgatttcgcttgccggcggaaaatatatttttgatgcatcaaatgacgacgatacaggcaggtcaactatgaatatgcagctagaggatttttacaatggagcaatagatgctgactatctgatatataacagtgcgatagacggcggtgtgaagaatctgaatgagcttttggacaagtgcccggtgcttgctgattttagggcagtcaaagacggcaatgtattttgcaccacgaacgatatgtatcagcagtctatgtccatcgggtatatgattgatgatatgcattcgatgattacaggtgcatccgacagcggcatgaaatatctgtttaagctcagataactgtgatttgtggaatgtatttggtgagctgaattgttaccggatatgacagaatgcaggaaaatcaatagcacaaaaagataaaaagcggagctacaacatggaaaaaaccagaaaaataaggtgttttacaacatttattattcttataatcttaattattatattgcttatcatgaatgtgtgcataggaactgtacacatatcgtttaaggctgcatttgcgacactttatgaccattcagacagggtaggacgtattgtgtgggatatccgcatgccaagagctatcgcagcgatgatattgggtggggcgttagcgcttgcaggctatcttttgcagactttttttcataatccaatcgcgggaccttttgtgcttggtatatcatcgggagctaagatgattgtggcacttgttatggtatttttacttggaaatgccatacgtgtgagctcactagccatgattgcagcggcgtttttgggagcaatgctttcaatgggctttgtgcttatcatttcaagaaaggtaagcagcatgtcaatgcttgtggtgagcggtgtcatgattggctacatatgctctgcggtgactgagtttgtggtgacatttgcagatgattccgacatagtaaacctgcacaactggtcgaggggaagcttttcgggcatgacctgggacagcgtcggggtgatgagcattgtggtgggaatcacatttgtttttgtttttctcatgtcaaagccacttatggcatatcagctcggagagtcatatgccgtaaatctgggtgtaaacataaagcgtatccgggtgcttctggtattgctttcaagcctgctttccgcatgtatagtggcgtttgcgggaccgatatcgtttgtcggaatagccgtgccacacatagtaaaaagcatgctaaaaagcacaaagcccatatatatgataccggcctgcttccttgggggagcggtgttctgcctgttttgtgatttgcttgcgaggatgatgtttgcgcctacggagcttagtatcagcacggttacggcagtatttggtgcaccggtagtgctgtttatcatgataagacgcagtaaggagaaaaatgtttgatggaatattattttactgctcaaaagctggccgttggatatgataacaggcctcttattgaaaatattgatttttccctcaaaaggggagagattctcacattaatcggaccaaacggtgccggtaaatcgactattttaaaaagtattgcaagacagctttcgcttgtgagcggtacgatatatcttgataaaagtgatgtagtgacgatgaatggcaatgaatttgcaaaaaaaatggctgttgtgcttaccgataagctaaagacggagcttatgacctgctatgatgtggttgcgaccggcagatatccatacacaggccggttcggagtactttcggatgaggacaaaaaggctgtggatgaggcgatggagctggtcaatgtatcacagataaaagataaggattttacaaagataagcgatggacaaaggcagcgggtcatgctgtcacgggctatatgtcagcagcctgagattatagtgttagacgagcctacctcatatcttgatataaagtacaagcttgagtttttatcaatactccaaaggcttaaaagacagaagaatcttacggttatcatgtcgctccatgagcttgatatggcaaagcgtgtgtcagaccatatcatgtgtatagatggaagatatgtggacagatacggaactcccgaggaggtatttactgaccaatatgtttcagggctttttggaattacggcaggaagctttgacgaaacaggagaggatttagagctggaaaaaccggatggaagggcgaggatatttgtcatagcaggagggggcctgggcagaaaaagcttcaggagcttacagcgaaagggtatcccgtttgcgacaggaatcatctatgaaaatgatctggattatcctgcggcaaaggcgctttctgctgagattgtcagcgcaagaagctttgagcctgtagacgatgcccttattgaaaaggcaaaggagcttattgatgcatgcgagggcgttatatgtgacagaacagagtttggcacgtatgagcagtttaacagcagactttatgagtatgcagtctctacaggaaaaattataaaaattccttttcttgaggaacaattggcacagctttaaggaagttactgttcacactacagtttaatattcatgataaagctaccacataaattcagacagcaggtatatatatggcaaaggtaattatggtacagggtacaatgtccaattcaggcaagagctttcttgtcgcgggcttgtgccgtattttcagacaggacggatacagggtggcaccgtttaaatcacagaacatggcgctcaactcttatataacagacgaaggacttgagatgggacgggcccaggtgatgcaggctgaggcagcaggcattaagcctatggtgtgcatgaatcctattcttttaaagcccacaaataatacaggctcacaggtgattgtaaacggaagggtgcttaagaacatgccggcgagagagtattttgcatacaagaaaactctcataccggatataaaaaaggcatttaaaaagcttgaggagtatgctgatatcatagtgattgagggcgccggaagcccggcggagataaatctgaaggaaaatgatattgtaaacatggggcttgcgcatatggtggatgcaccggtgctgctcgtgggtgatatcgacagaggtggcgtttttgcgcagctgcttggtacacttatgcttttaaccgatgaggaaaagaatcgtgtctgcgggcttattatcaataaattccgtggagacaagacgatccttgacccggggatacagatgcttgaggagagaggtggggtgcctgttaccggagtggtgccatatatggatgtacagcttgaggatgaggacagcctgacagagcgctttgacaaaaagacagatgggcttattgatatagcggtcatcagatatcctagaatatcaaatttcacggatttcaatgtctttgagcagatgtcagaggtaacagtgcggtatgtgtcaacagtaaatgagctgcgtcatccggatatagtatttttgccgggaagcaagaatacgatgggggatcttttgtggatgagacaaaacggactcgaggccgctgtcaaaaagctctcctatgagatacctgtttttggaatatgcggaggctatcagatgcttggggtttcaatagccgaccccgacggtgttgaggagggcggatatatgcgtggcatggagcttcttcctatagataccgttctaaaagacagcaagacacggcttcagacaagcggtgaaatagcacatgtagatggtgtattgagcaggctttcaggctgtcactttctgggctatgagatacatatgggtaagagcgcatatagcgcagcttcagatgagcagggggcttgtgctgacaggaaaaatgagttaaataatgtcatatctgatggcagaaatgtgtatggctcgtatatccacggcatttttgatactgcagaggctgccagagtgatagtggattatattgccgataaaaagggcattgatgtgaatgacagcgctattgtaggctataagagctttaaggaaaaacagtatgacaggcttgcggatacactgagagagtatctggatatggatgcagtgtacggcatgcttcgtgaggcaaaatatgattgaaaacaatattatttctgaccattttacagttgaagaattaaaaaaaataaagataactccaccagatgaaaaaatgtacaaaaaaatccgttcaaactgggattcggtggcaaagccgctcgacggcatgggtgattttgagcctttaacggctaaaatcggcgctgttttgggagatgaaaatatagatatctcaaaaaaggctgtcataatgatgtgtgcggacaatggtgtggttgctgagggcatcagccagtccggacaggaggtgacacttgcagttgcaaaatccatggcaaggaaggcctcatctgtcggacgcatggcaatgactgcaggggctgatacaattcctgtggatataggaataaacagtgacgagagtgttaaagggctgattcaaagaaaggtgcgtatgggcacaagaaactttgcaaatgagcctgccatgacagaggaagagacacttgaagcgattgctgcaggtatagatatagttagggagtgtaaggcaaacggctacagaattattgcaaccggtgagatggggataggaaataccaccaccagcgcagcaatggcagccaccatgctaaggtgtgatgtggccacagtgacaggaagaggtgctggcctaagcgacagtgggcttgagagaaaaatccgtgtaattgaggacgcaatagaaaagtatgatttatataataaggatgcctttgagatacttatgacagtcggaggccttgatattgcaggacttgccggagtgtgtataggtggtgcaatataccatattcctgttgtgctcgacggagtgataagcatggtttcagcgttggcagcaggaaggcttctttccggagttactgattttatcattccatcacatgagggcagggagcctgccgtggcgcttttgtgtgaggcactttccgtaaggcctgtcataagagcatcccttgcgcttggagagggaacaggtgccgtgatgatgtttgcgcttttggatatggcacttagcgtatacaaaggccggacaaccttcgacgatatctcggtatcacagtatgagaggtacgtatagatgattacacttataacaggcggcagcggcagtggcaaatcagcatatgcagaaaagtatatttgtcaagtgtcaaatgaaaagggatacaaagaaaaatattacattgccaccatgcaggtatttgatgatgaggggcaacggaagatagacaggcacagaagacttcgtgccggaaaaggctttattaccatcgagcaacctcgtgatatccaaaatgcggtttctaagctgcaatcagaaagcagtttaaaaaccggacggtcagcactgcttgagtgtatgtcaaaccttgtggcaaatgagatgtttccacctgtagatgcttccggtatacaggctgccgaagctgaaaaagaggctttggatgaccttgaaaatatgaaggattatgagactgctcaaatcagccatgtgagtaaaaaggtgttaaaagaggtaagtatcttaagtgaaaatgttgctgagcttgtaattgtgacaaacaatgtatttgaagacggagtctgctatgatgaatcaacgatgaattacataaaggcaatgggaattgtaaacagagggcttgctgcgatggcagagagtgtcgttgaggtggttgcaggcattcctgtgacggttaagtgaagcagtgtggaggttaagtgtattatgaagttaataaggtcgtgcatagtatctttttccatgtattcaaagatacctatgccacaatttaaatggaatgatgatgacatgaagtacatgctggtattctttccgtggataggagctgtgattggactgcttcttatgctttggagatatatatactctcattttggagtagcggatatctgctatgtatgcataggcgcactcattccgatagcggttacgggaggctttcacatagatggttttatggatacaatggatgcgtttcattcatacaaaccgcgggaggaaaagcttgcaatacttaaggattcacatataggagcgtttgccgttataatgcttgcagcctacggattattattcatgggagctttttctcagataatggatgataaagcatttattgttttttgtgcaggctttttcatcacaagatgcttaagcgggatagctgttgtgtcatttaaatcggcaaaaagcgatggactgttatttatgtttgcggacactgcacacagaacgatagtcagggcagcactatacatccagcttgcactgtgtatggctgttttactcattgtgtcactgccttatgcggtggctatgatcattgcggcagcacttagcttttggtattattatgtgaaaacaaaaaaggagcttggcggcatcacaggcgatacggcagggtattttgtgtgtatatgtgagtgcgccatggcagtggctttgggtggtgtctcttttattatttagtatatttgttttgaatataggaatggtacggataagaattttgataaaagttgtactatgaatttaaaactttggaattggagaaaatatgaagcttgtgataggcggagtggcacagggaaagcttgattatgtgctcgaaaatatgatagaagaatcagaaaaatatgataggtatgactgcttttttcaaaaagataatgcctgcaatgataaggcatcaaacatggaatggccatgggattttgacgttgatgatgagagtatacttataatagataaattccattattttatcagggctgtgcttgagaaaaatcttccgctgcaggaatatattttgaaatttatgcagtttgcagaggaaaataaggatacaatagtcattgctgatgagattggaaacggcatagtgcctcttgatgcgtttgagagagagtacagggagcagacaggcagagcggagatactgcttgcaaaaaaagcagatgaggtagttcgcgtaatatgtggaatcggtcagaaaataaaataaactgtatatttataagacacggctgcactgtctcaaacagagaacacagatatctgggcaggacagatgagccactcgatgaagccggagtttttgaactagaaaatgcgctaaataatggtgtatacaaggctttggaggaaaatagcttaaaggagcagataattattaccagtccaatgaggcgctgtaaacagacggcagagattattttgccggtcgcacagcaccataaaattcataccgtaaaagagtttgcagagatggatttcggtgaatgggagctaaaaaactataaggaacttagcacagatatccgtttcagggactcatatcaggcgtggattgacagtggtggaacacttgcctttccaaacggagagagcagaaaagagttttgcaaaagaagtatatgtggctttgagagggcgctcacacaggctttagagcttaagagggctatgcttgataaagagatacaaatagtattttttgtgcatggagggactatcatggcgataatgagccattactgtgatatggattactatgattaccaggtgaaaaacggctgtggctactcgtgtgaggttgcggttgagggcaatgagattgtgtttaatgaaatagtgcccatatcgctatgatttatttaagaaggactaacatatgtgttatcatatttttgcatttatagcaggctttgtgcttgatttattaataggagatccgcattttataccgcatccggtcaggcttatcggctcactcatttcttttctcgataagaggcttaattgtgatgccggatataatatctctgaaaaaaaattaaatctaataaaatataaaagaggcatgcttcttgcttttactgtaatttttgcaacttttgcaatatcggtaattattattgtggcagcatacagtataaatttatatgccggggtaatagcagaggctgtcatgacgtggcagattcttgccacaaagtgtcttcgtgtggagagcatgagggtgtacgatgcgctaaggacagatggagttgatgcaggaagaagggctgtttccatgattgttggcagagatacatctgtgcttgatgcagcaggcgtcacaagggcggcagttgagacgatagctgaaaatacatctgacggagtgattgcacctatgctttacacggcaatcggaggaccggtgcttggctttgtatacaaggctgtgaatacgatggactccatgcttggctacaaaaatgataaatatatgtattttggcagatttgctgcaaagtttgatgatgtggtcaatttcataccggcaagaatcagtgcatatctgatgattgctgcggcatttatcggtggcaggcagtttgatggcaaaaatgcataccgcatctttaaaagagatcgtttcaatcacgcaagccccaactcagcccagacagagtccgtatgtgcgggcgctttaagggtgcagcttgcgggggatgcagtgtatttcgggaagcttgtgaagaaaaaatacataggagacggtctgcatgagatagagtacgaggatataaagcgtgcaaacaggctgatgtatattactgcgtttttgtgtgagcttttatctgtggcggttatgagtcttgttttaatattgctttgaatatgaaaaattgatgtaagaatagaaggaggacttgaatgaaaagcatccatggcggtgacatatacaacaataaagtaaatatggatttttcggtaaatatcaatcctcttggcataccgcattctgttaaagaggctatgagtgatgcactttcgtatgcagacagatatcccgacatgacatgcagtggccttaaaaaagcgatatcagagtatttcacacagcaaggctgcagcatacaaagcgaggacgtaattcccggaaacggagcctcagagctatttatggcgatagctcatgccataaagcccaaaaaagctgtgcttccggccccgggctttttcggctatgagcatgtgcttcgtgcagtcggctgtgatatcggatatttcctgctggatgagcagagtgatttttctcctgctgcacggctggatgctttaaaggatatgcttacagatgatacagatatattttttatcgcaaatccaaacaatccgacagggtatcttgcagacagcactttcatgaagcaaataatagggcattgcaaagaaaagcatatttatgtggtggcagatgaatgcttcatcggcttttgtgaaaaaaattattctgttttgtcacttttatgtgactatgacaatctgattgttgtaagagcctttaccaagctttttgctattccgggagtaaggcttggatatatgctcagtaaaaatgaggcagtaagacaaaagatccaaagaaatctgccggagtggaacgtgtctgtcctggcacagatggcaggagaggcatgcattagggaatcagagtatattaaagaaacggcatcgtatgtgagcggacaaagaaggctgctgtcagatggactaaaaaagcttggttttaaggtatataaaagtgatgctgatttcatactgttttacagtgagcttccattatatgatatactgcttaataagggaatactgatacgggactgctccaactatgtggggctttcggaagggtattttcgagtggcggtaaagacatttaatgaaaatgtaagattattgaaagtgataggtgagtgtattgaaaaaaattaaacagttagagccgatggagattgaaaagagaagctttgagataatttcacatgagctgtctgaaatgcagattacgctgcctgctgatcaggagatgataacaaaaagagtcatacacacgagtgctgattttgattatatacagacgcttaaatactctaaggacgccgttgctatcgcaaaaaggctgatatcagagggcgctgatatagtgaccgataccaacatggctctttcaggcataaataaaaaatatctggcaaaattcggcggacaggcgcactgctttatggctgatgatgaggtcgctcttattgcaaaggagaaaaagacaacgcgcgcggcagtaagcatggagtttgcatcaaggatagataagcctgtgatttttgcgataggaaatgcaccgacagcgcttatagagttgtacgatatgatagaaaaaggaatatataagcctgcatttgtaatcggtgtgccggtgggctttgtcaatgtggaagcagccaaggagctaattatggagaccggagtgccatacatagtaaatgtcggacgaaagggtggcagtaatattgcggctgctatatgcaatgcgctgatttacagtctggttgatagaggctgatgcatgaggaaatttagtgattatgagatatggatttaccacaggaagctgtgcggcggcggcatcaaaggcggcggcatatatgcttttaaccggaaaggctaaaaacaaaataacgattcagacacctaagggaatagcttacacggctgatataaccgacataaaaagaagtgaaaatgaggtaagctgcgccgtgataaaagacggaggggatgaccctgatgtgaccacaggagcctatatatatgcttctgtacggattttgcattccgatacctgtgctttatgcaaaaaaaagcaggatttggttatcataaatattgatggtggtgacggagtgggaagagtcaccaaacctggattagaccagcctgttggaaacgcggctatcaatcatgtgccgcgtgatatgattgaaaaagaggtaagggaggtctgtgagcttttggatttcaaggggacacttgatatcacaatctcggttccaaagggaaaggagcttgcagaaaggacctttaatccaaggcttgggatagttggtggtatatcaattctcggcacaagcggtattgttgagcccatgagctcacaggctcttattgatacgataagggtggagcttaggcagagatattcgtttggatatgattatgtggcggttgcgccgggaaattacggtcttgactttatgaaggaaagctatggctatgatctggacaggagtgtcaaatgctccaactttatcggtgaaacaattgatatggcagccgatatgggctttaagatgatgcttttgacaggacatataggaaagcttataaaggtagcaggaggcatcatgaacactcattcgagggaggcagactgcaggatagagcttttgacggcatttgcgtttaagtgtggtgtagcgcctgaatacataaagcgcattatggacagtcttacgacagaggaggccctggtggcacttaaggaaagcggcaggctgtatgaggtaatggattatgcgatggagcgcatatgcttttatctggataagagggcaaagggcagacttgagatagactgtatcatgtattcaaacgaatttggtgagcttgcaaaaagcagaaaggcagaaaaatggtttactttgttggcgcaggaacaggcgcagcagatttaataacagtacgcggaatgcgtcttttacaaaaggcagatgtgataatttatgcgggctcgcttgttaatccacagcttttggactatgcaagggagagctgtgaaatatataacagtgcaaaaatgacactggatgaggtcatcgcagtcatgaaagctgctgaggcagacggaaaaattactgtgcgcctgcacacgggagagccaagcatatacggcgcagtgcgcgagcagatggatgagcttgatactcttttaataccatatgagagctgtccgggcgtgagcgcgtgctttggcgctgctgcatcgctcaacattgagtacacgctcccagggatttcccagtcgctcatcatcacacgcatggaggggcgcacgaaggtgccgcctaaggagagcatagcaagctttgcctcacaccacgcttccatggcgatttacttaagcaccgggcttttagggaagcttacggaaagccttattgagggaggatacgcggcagatacacctgctgcaattgtatacaaggcaacctggccacaggaggaggcatacgtgtgcactgtcgctacacttaagcagacagcgaggaagcacaatatcacaaagacagcgattgtgcttgtgggggatgtcatagctcacaggcattacgagaaatcaagactttatgcgccggatttttcgacagagtatcgcaaggcttctgtagagtcgcaggataacgattaaaaaaggcgtgaatatataaatatgggaaatatatgggaattgaaaatatgaaaatttgcattgtaagcttcacaaaaaagggctatgagctgtcatgtgacatagctcataagcttaaaaaaagtgtatatgaggcggaggtttttaccaagtgctcgagattatcgtatgagaatattaaaaattccaccgatgaaaattatagaaataccggctacatatcacaaaatatatcagactggacagctgcacagatgagtgaaaaaaaggctctgatttttatcggggcatgtggtattgcagtgagggctgtagcttcttctgttaataacaagcttaaagacagtcctgttattgtgatagatgagctggggaagtttgttattccgattctttcagggcatgtgggaggtgccaatgagcttgctgtattattagcagcaatgatgaatgccacacctgttataacaaccgctactgatatcaataataaatttgcagttgatgtttttgcaaagaaatgcaggcttgcaatagtcaataaagatggcattgccaaagtgtcatcaaaggtattggcaggagaagtggttactatgtcggtcgattgggagcacatcccggataagcacagaagtcttataaaggcatttttagatgaagctgatatgagtgctgatgcaataaaaacagtggacttcccacctgcttacggagctgatattgtagtatcatgcgaaaaagcaatggaccctaaaaatggcagtatttacttaaaacccacacacattgtacttggtattgggtgcagaagggatacagcgtttgaaaatattgacagtgcaatcagacaaagtcttttaaagctacaaatagatatttcggatatagacatgatcgcatcaatagatgtgaaaaaagatgaaccgggaataaaggaattttgcgaaagaaacaggatagaatttgtcacttataccgcggatgagcttatggcggtgcagggagaattcagtgcctcgcagtttgtcatggagcatgttggagtggacaacgtgtgcgagcgtgcagcagtgcttgcatgcatcagggaatgtaacgaagcaggagaacttatctataaaaaacataaatatgacagggtaacggttgcggcagcaaggtatcctgattaatcataaatgaggggcaaaataccttttgaccttcatatcattaaaaaattgcaaatagctgcatggttatataaaattagtagagatggagattaacatgaataaaatttacatagtaggtatgggaccgggctttgaaagcatgatgacaaagcaggcgattgatgccctggaagcgagtgatgtcatagtgggatacaccgtatatataaagctgcttggagaaaaattccagacaaaagagcttttgaccactccgatgcgtcaggaaaaagaaagatgtcatctgtgctttaaaaaggcacttgagggcaaaacagtctctcttgtatgtagtggcgatgccggaatatacggactggcctctcttatgtatgagattgggcaggaatacgataacgtagagctttcggtaatacccggcattacagcggcaaacagtggtgcggcagtgcttggagcaccattaaaccatgatttttgtaccatcagcttaagtgacctgctcacgccgtgggaaaagattgaaaagcgtcttgtggctgctgcagagggtgattttgtcatagcactgtacaatccgtcaagtcacaagagaaaggactatctgatgagagcctgtgatattctgcttcgtgcaatcgagccggatagagcctgcggttatgtcgaaaatatcggacgtgagggaacaagctatacggtctgtactctcggtgaactccgcagtgcacaggttaacatgtttacgacagtatttatcggcaatgagggtacacaaataattgacggaaagcttgtcacaaggagaggatatcagattgagtaaaatactgatttttgcaggaacaacagagggacgtaagctatcagagcatctgtgtaaaagaggcatagagcatacggtttgcgtggcaacagaatacggtgaaatcgtgctgcatgaaaatccgttcgcgcatgttcatatggggcgtatggacagcgaaggcatgagaagcttctttgcggaacaaaaatgtaagctcatagtggatgcaacccatccgtatgcagccatagttaccgaaaatataaagcaggcattttatgcttttaatgaggcacatgctgttacagacaatcaggcggatagcagcatatcacaaaatatcgaatatgtgcgtcttaaaagagatacggatatatcagcagattatgataatatccgctattttgaggacaatgaagcatgtgcaaaggcacttaacaatacagacggaaatatactgctcacaacaggaagcaaggagctgtcagtgtattgtaaaacctcagacgtcagggaaagattgtatgtgcgcgtgcttccggggcttgagagcataagcttatgcatgaacaatgatattacaggaaagcacattctggcattgcagggaccgtttagcacacagcttaatgaggcgcttattgatcagtatgacatcagatgtctggtcaccaaaaaaagcggtgcggccgggggctttattgagaaaataactgccgcaaaaaataaaaatattccggtctatattgtgggacaaagcgtgcaggatgatggaatgtcatttgaagctgtttgtgaatatattgacagtaaatataacaagcttcatatcatgtttgccggcattggaatgggaaatgatgcttgcatgacgaaagctgtttcagatgcaatagaaagcgctgatattatacttggcgcaagccgcatgatagaaaaatacagtgcgaagatagacaaaaagccgtattatcttgcagaacagattattccttatctatacgaaatttgtgcagatactgcaaaaatcagtaatgttcttatattattctcgggagatacaggcttttacagtggaagcaaaaagctgtatctggcgataaaaaatgaaatatctgaaggtaaattaaatgcggatgtgtcaatcctttctggaatttcatcggtgtcatatatggcggcagcggtcggtgaaacctacagcgatgcatatatttgcagcatccacggagtaaagctttctaatatcacatcacggattagccaccatgcaaaaacatttatgctgatgtcaggtgtaaaggatgtgaatatgcttggacacctattaagcagtgacgaaaggtatggtttacaaaaatgctcggtaactgtgggataccagctatcatatccggatgaaactatatcgcagctttcgccgcaggagtgcacaaagcttaaaggggaggggctgtatatctgcatgataaaaaatcacaatccggttgcaaaaaatgttacaccgcagctaagtgatgcagcatttatccgtgaaaaggttccgatgaccaaagaggaaataaggcatgtaagcatctgtaagcttcatttgaaatcggattcagtgctttatgatgtgggaagcggaaccggctccatagcggtagaggccgcatcactttccgatgatatggaggtctatgccattgagcagaaggaaaatgccgtgcagcttatcacacaaaataaagaaaagcatggacttgaaaatatccatgttataaatgcaaaggctcctgacggaatggacactcttccggtgccgacacacgcatttatcggaggcagcggtggcaatctaaaggagataatagaggctcttaaagcaaaaaatccacatatccgtatagtgataaatgcaatttctatggaaacaatttgtgagataaaggaaatattgtcggcatatgatgtgaaaaatgaggatatcgtgcagctgcaggtcagccgctcaaagcagataggacattaccatctgatgcaggcagaaaatccggtgtggatatgttcatttgaattttaacccgggcttttatgctacaacccgtaataaatcatcaaaggctgatattttaagatatatgatgaaataaaggatgaatacatgaaaataaatcgttttatgatagccgcgccaaaaagcggcagtggaaaaacaatgataacctgcgctttactgcagctattaaaggatagcggaaaaaacgtattgtcatataagtgcggacctgattatattgacccaatgtttcacaaaaaggtgcttggcgtaccatccaaaaatctcgatacgttttttacggatgaaaagacaacagtgcagcttttcttagatgaaagagccgatggtgattttgcggtgcttgagggcgtgatgggattatatgacgggcttggcggaatatatgagcaggggtcgtcataccatctggcaaaggtgacgcagactccgataatactcgtggtggacgcaaagggaatgggaaagtcagtgcttgctcttatagccggttttttgcagtatgacacgcaccacttgattaagggggttctgctcaatcggatgtcgaagggctattatgacatcataaagcctctgatagagaaggagctttccgtaaaagtagtcggatatttcccggaacagaaggatattgggctttcaagcagacatctggggcttgtcatgccggatgagctttcagatataaaaaaacagctcaatgaaactgccgacaggctaaaaaagacaatagatatggatttgtttatagatatagcagaagcggcagatgaaatcggtgacagcggaagtgcagataaagataagcgtaaaaccttaaaaaatgcagagcctatgaggcttcaagaccaaaataataccgtaaacatagctgttgccatggacgaagccttttgtttttactatgaagataacctgagaatgctcgaaaaatgcggtgcaaaattacagtatttttcaccgcttcacgataccagccttccagaggattgtgatgcaatgctgcttggaggcggttatccggagctgtatgcaaaggaactgagtgaaaacgtatctatgctgaatgccataaaaaaagcttttagagccggaatgccgacggttgcagagtgtggagggtttatgtatcttcacgcatatatccgtaatatctgtgatgatacagatgagcaaaataaggctgatgtacaaaacaaagcagatatacaaaatgatatgaataagtctaagcttgtgggggcactggatggtgggtgtcattttaagggaaagctggtcaggttcggatatattgagcttgcggaaaagcatagcaattttctaccgccaaatgaaaaaataaaggcgcatgaatttcattattacgacagcaccgataacggagctgattgtattgcgaccaagccggccacaggcagaagctacgactgcgtgataagccatgataattactggcttggatttccacacctgtattatccgtcaaatccgcattttgcagagagccttgtgagaaaagcatatgaatatagaaggaataaaaatggaaaactcttataaatactttaaaaacaaagattgcaaatattttccgtgtcacaagggactttcggatgactttaattgtctgttttgttattgtcctatgtatagtatgccaaactgtcccggaagtaagacctacatagagaagaatggcaaaaaaatcaaggtatgcacagactgtacgtttccacacagactggaaaattatgataaaatcatacagattttgattaggaataataactgaattaaccactaaaatcaatttaatagaaaatttataaagcctgaaaccctagtaaaatcaagggtttcaaaaattttattaaaaaaattagcactcgagggttgacattgctaataggtggtggtatgttatgtacagataaaaaattagcactccaaaatacagagtgctaacaaattaaaagcatacttcagatggagcgtgtgaccaatggaaaatgaaaacaaagaactagaattgagcgagagacagcttaccatactggatgcaatcatccgcaattatctcgccacaggagagccggttggctcacgtacaatttcaaaatatacagatcttaatctgagctcggcaacaatcagaaatgagatgagcgacttagaggagatgggctatatagtacagccacatacctcagcaggaagaattccttcggataagggctacagattatatgtagaccatcttatagagaccaatgataagaaggaaaaagagctttctgatatgaaggagctggtcattgaaaataccgagaagatggagcaggtgttaaagcaggcggcaaaggtactcgcaaacaataccaattatgccacacttgtttctgcaccggatgtcaatcacaacaaggtgaaattcatccagctttcacaggttgacgaccagcacctgcttgcagtaattgttatgaacaataatatggtcagaaacaagatgcttgatttatatgagccgcttgacaatgagacgatacttaagctcaacattctgcttaacacctcattaaacggactcgcaatgaacgagattaatcttggaaacattgcaagcataaaggaacgcgctggtattcattcaggaattgtctctgatgtgattgatgcattggcacagaccttcgcggagagtgaggatcttaagatttacaccagcggagcaacaaatattctgaagtatcctgagctttcggattccaataatgcagcgacacttttgtcagcatttgaggaaaaggaagagctagcaagccttgttactgaatccctatccgattccgagaagaaggacaatggaacaggcattcaggtttatataggaaatgaatctccaatccagaccatgaaggactgcagtgttgtcactgcgacatatgatctgggtgagggcgtaaagggaacgataggaattgtcggaccaaagcgcatggattatgaaaaagtaatggataatctaaagactcttaaatcccagttagatggaatttataagaagtctgaggatgaaacataggaaggtggtcaaaaatgccagagaatattaaaaaagaaacaatcgacaatgagactgcagaaaacaaagcagaagagatagagattgaaggagctgatgaggaaagcactcaggcagccgaagaagcaaaagatacagatgtgaatgaaactgaatcagatgatgatgctttagcagatgcagatgcaaaagcagatgataagtcagatgaaaagtcagatgaaaagaaaggtctcttcaagaaaaagaaaaaagacaagaaggacgagcagatagaagaacttaacgaccgtctgaaaagacagatggcagagtttgagaacttccgcaagagaagcgagaaggaaaaatcccagatgtttgacatgggagcaaagacaatagttgagaaaatccttcctgtaatcgacaatttcgagagaggtcttgcagcagtaccggatgataagaaggatgatccttttatcacaggtatggataaggtctacaagcagatgctcacagagcttgatgctgcaggtgtaaagccaatagagtgtgtaggacaggagtttgatcctgatttccacaatgcagtgatgcaggttgaaaatgatgaacttgagtcaggcaccgtagcacaggagcttcagaagggctatatgtacaaggattcagtggtacgtcacagcatggtatcggtagtacagtaatgatgtgtacatctatccggcatgacagtgaatcagatttatatgaatgcagacagcatttaagggattcatgtgggacaacggatggttacaaataaatgaaacatgtaaaaacactatatttaataggaggaaaataaaatgggcaaaatcattggtattgatttaggaacaacaaacagctgcgtagcagttatggaaggtggaaaacctacagttatagcaaaccaggagggtgcaagaaccacaccttcagtagttgctttcacaaagacaggagagagacttatcggtgagcctgcaaagcgtcaggcagttacaaatgctgagaagacaatttcttctatcaagagacatatgggtacagattacaaggtgcagattgatgacaagagctacagcccacagcagatttcagctatggtacttcagaagttaaaggctgatgcagagggataccttggtgagaaggttacagaggcagttatcacagtacctgcttacttcaacgatgctcagcgtcaggctacaaaggatgccggcaagattgcaggtcttgatgtaaagcgtatcatcaacgagcctacagcagcagcacttgcttatggtcttgacaatgagaaagagcagaagattatggtttatgaccttggtggtggtacatttgatgtatctatcatcgagattggtgacggagtcatcgaagtattatctacaaacggtgatacacaccttggtggtgatgatttcgataacaaggtaacacagtggatgattgacgagttcaagaaggcagagggtgttgatctttctacagacaagatggcactccagagattaaaggaagctgctgagaaggcaaagaaggagctgtcttcagctactactacaaacatcaaccttccattcatcacagctacagcagagggaccaaagcatttcgatatgactcttacaagagcaaaattcgatgagctgacacatgacctcgtagagagaacagcaatcccagtacagaacgctatgaaggatgcaggcgttacaaatgcagaccttggacaggtattacttgtaggtggttctacacgtattccggccgtacaggacaaggtaaagcagatgacaggaaaagagccaagcaagtctcttaaccctgatgagtgcgtagcaatcggtgcttctatccagggtggtaagcttgcaggagatgccggtgcaggcgaagtacttctccttgatgttactccactttctctttcaatcgagacaatgggtggtgttgctacaagacttatcgagagaaatacaactattcctacaagaaagagccagatattctctacagccgctgataaccagacagccgttgatatcaacgtagtacagggtgagagacagttcgcccgcgataataaatcactcggacagttcagacttgatggtatcccaccagcacgtcgtggagttccacagattgaggttacattcgatattgatgcaaatggtatcgtaaatgtgtctgcaaaggatcttggaacaggaaaagagcagcacatcacaatcacagcaggatctaatatgtctgatgatgagattgataaggctgttaaagaggctgctgagtttgaggcacaggataagaagagaaaagaagcaatcgatgcaagaaatgatgctgagagctttgtattccagacagaggatgcattaaagcaggttggagattctgttgatgccgctgataagtcagcagttgaggctgatatcgcagcagttaagtcattccttgatgcacataaagaggctgaggctatgacagaggctgatgttgcagagcttaaggcagcacaggagaagctcacacagagtgctcagaaggtatttgcaaagatgtatgagcaggctcaggcagcgcagggagcagcaggagcaggacctgacatgaatgcaggagcagcaggagcaggacctgatatgaatgcaggcgcttcaaacggtgcagatgatgatgtcatcgacgcagatttcaaggaagtataattaaacagatgctgccataatgatatgagaattaatgacctgtaattctggttatcaatcaaagcatcataatggctgcgtaagtaaaattactcgcaaggttggccgcttggccggccttgcgaattagttgtataataaaaggaattttcaattatggcagaaaaaagagattattatgaggtattaggagtatctaagaccgctacagatgcagagattaaaaaagccttcagacagcaggcaaagaaatatcatcctgacattcatccgggtgataaagagtgtgaggagaagtttaaggaggctcaggaggcctatgccgtattgtctgatccggataagagacgccagtatgatcagttcggtcatgcagcatttgatggcacaggcggcggagccggtggctttgatttctcaggcatggatatgggggatatttttggtgacattttcggagatttcttcggaggtggaagaagcagtggcagaagaaatggtcctgcacagggtgcaaatgtccgtctcagtgtaagaatttcttttgaggaagctatatttggctgcacaaaggagcttgaattcaactataaggagacatgctctacctgtggcggcaacggagctaagccgggcacatctcctgagacatgtacccagtgtaatggtacaggtaaggttgtcagacagagtcagtctctgtttggtgtagtgcagaatgtcacaacatgtccatcctgcggtggttcgggcaaggtagtaaaggataagtgtcctacatgtcacggtacaggctacaataccaagaaggtcagaaagactgttgagattccagccggtatagataatggacagtgtgtcagaatacgtgaatacggcgagccgggcataaatggcggaccgcgtggagatcttcttgttgaagttattgtttcaggcagcagggattttgagcgtcaggatgttaatatcttttcaaaggcatccatctcgtatgctattgcagccttaggtggagatataagaatcaagactgttgatggagatattatatacacagttgcaccgggtacacagacaggtacacgtatccgcttaaagggcaagggtgttccttcaacaagaaataaagcaataagaggtgaccattatgtcacacttgttgtcaatacgcctacaggtctgtctaaggatgctaaggaggctcttaagaagtttgatgagctttcaggcggttctctgaccaaggagggcggagcttctactgattctaaaaagaaaaaaggatttatggataagctcaaggagtctttggacgatctgtaaatagatgatctgtaatagatgtcctataatatatgtcccgccatgtgtggcggggcattttttaggctatttttacgtataaaaaaatggggcttttatacagcacatttttatggtattatatgagataagttgtggaggcagtcgtatgactgccttgtaaaatgtacggaaatgttttgaaataaaactgtatttatactatatatctattttattaagagaggatttttatatgaagtggaagaaatacacgattgagacaacaaccgcggctgaggatttcatgagcagcatgcttatggagcttggtatcgaggggatcgagattgaggacaatattcccctgaccaaagaggaccaggcggatatgtttattgattttctgccggagctgcctccggatgagggcataagccatgtcagcttttatattgaggatgatggcagtgatcagtctgatatgcttagaaaggtaaagcttggacttgaggatttaagagatactgttgatgtgggaagcggtgtaatttcgtcatctgagacagaggatctcgactggattaataactggaagaagtatttttcatcatttacaatcggtgatatattgattaagcctacatgggaagaggtaaagcctgaggatgcggataaatttatgatagaaattgatccgggaatctcctttggtacaggaaagcacgagacaacacagctttgtatcaagcagcttatcaagtatattgagggcgcaaaggaagcacctacagtgcttgatgtgggctgtggaagcggaatcctttcaattgtagctttaaagcttggtgcaaaggaggttgtaggtactgaccttgatgctgactgcatgatttctacgcgtgacaatatgcaggtcaatcatctggatgagaagcttggcacgttttatgtcggcaatctcatagatgatacagagcttcaaaagaaggttggtacagaaaaatatgatatcgttgttgcaaatatccttgctgatgtcatcattcctatggcacctgttattcctgacaggttaaaggaaggtggatatttcatcacatcgggaatcatagatttcaaggaaaatgaagttaaagaggctatcgaagcagcggggcttaaggtgatagaaatcaatcatcagggtgaatgggtcaatatcactgcgcagaagctgactaaatagtttggtggattatgtatcagttttttgtagaggaagagcaggttcattctgacagcatctcaatcaccggaggtgacgtaaatcacataaagaatgtactgcgcatgaaaaacggggaaaaaataagagtaagctcaaaatccggacaggcatatttctgtcacatatcgtcgattctggatgatgaggtcatcgcagctattgacagtgcagatgagacgggcacagagcttgacaatcacatcgtgctgtatcaggggctgccaaagggcgataagatggagcttattattcaaaaggctgtggagcttggtgtatctgagatagtaccggttgccatgaaaaactgtgtggtaaagctggatgaaaaaaaggcagcaaaaaagctgcagagatggcaggctatcgctgagagcgcagcaaagcagtcaaagcgcactgtgattcccactgtgaagcagcctgttacatacagggaagctttgaaaatcgcttcagagcttgacatcacgctggtgccatatgagaatgagcgtggcatggatgcgacaagagagataatggggcagcttaaggcgggtcagactatcggtgttgtagtgggtcctgagggcggctttgcaccggaggagatagcacttgtggatgagcatgccacaatgcacagaataagcttgggacgcaggattttacgcacggagacagcaggacttgctgcacttgccatgcttgtatacaatttggatgtatagacagtagagatacttaacagttaagaagtagaagttaggagcaaaaatggaagcatatttggataattctgccacaaccagatgctcaaaagcagcggcagatatggtttataagctgcttacagaggattacggtaatccttcatcacttcatatgaagggcgttgaggcagaaaattatattaatgatgctaagaaaaagattgcaaagacactcagggtgcaggacaaggagatactatttacatccggcggcacagagtcgaataatactgcaataataggtgttgcaatggccaataagcgtgcaggaaggcatataatcacatcttctgtagagcacgcatcggttttggctgtgatgcagtttctggaggagcagggctttgaaatcacatatctgcctgtaaaccatgacggcgtgataagtgttgaagagctgaaaaatgcagtaagggaggatacaattcttgtatcgcttatgcatgtaaacaatgagattggcgcagtcatgccgattgaggaggcgggagcagctataaaagagaaaaatcctgccacactttttcatgtggatgccatacagtcctacggcaagcttgaaatcagaccaaagcgcatgaatatagacatgctttcagtcagtggacacaagattcacggaccaaagggcagcggatttttatatataaaagacaagactaaaatcaagccgattatatacggaggcggccagcagaagggcatgcgctcaggtacggaaaatgttcctgcatatgcaggtcttggagtggcagcagaggaaatttacacggattttgataaaaaaatagcacatatgtatgagcttagggatcattttatagagtcagtgcagcgtattgacggagtatcggtaaacggacgcacggaccatacaaatgcacctcatgtggtaagcgtgagcgtagatggtgtgagagcggaggttatgcttcatactcttgaggacaggcagatatatgtgtctgcaggaagtgcctgttcatcaaacaaaccggcaatcagttcaacactaaagagcatagggcttaagccgtcacttttggattccacgatcagattcagcttttgcgtgaataccacacaggaggaaattgattacgctgtatcagtgatggcagaggtgataccaatgctgcgaagatatacaaggcgctaatgagctgcaaagagatcgcaggtattagcatagccggtaataatgaagggctaaaaagttacgcatacaatgaaatattaagtaattaaaataataaataaaaccagaacaggagagttacatgtacaagacatttttgatcaagtatgctgagattgcgataaagggcaaaaacagatacatttttgaggacgcgctcgttaagaatattaaatatcagcttcgcaatgtggatggaagctttgaggtaagaaaggaaagtggacgtgtgtacgtggagacagacggagactatgattatgacgagacagttgccacattgtcaagaatttttggtatcgtgggtatctgtccggtcgagctgcatgaggatgagggctttgacaagctctgtgaagcagttatcgagcatatcaaccatgtatacaaggataagagctttaccttcaaggtaaatgcgagacgtgccagaaagaactatccgatgacctccatggagataaatgccgcagtcggtgaaaaggtgctggaggcatttcctgagacaagggtagatgttcataatccacaggttatgatcaatatcgagatcagacctatgataaatatttattcagaggagattcctggaccgggcggtatgccgcttggcacagcaggaaaggcaatgcttctgctctcaggtggaatcgacagcccggttgcaggatacatgattgcaaagcgaggcgtggtaatcaatgccacgtattttcatgcaccgccatatacgagtgagagagcaaagcagaaggttgtagaccttgcaaagaaggttgccagatattcgggcaggataaagctgcatgttgtcaattttaccgatatacagcttgccatatatgagaaatgtcctcatgatgagctgaccatcatcatgcgcagatacatgatgaagatagcagagcactttgccgatgaggataaatgcttaggccttatcacaggtgagagcatcggacaggttgcaagccagacaatgcagtcacttgctgcaacaaacgaggtgtgccatatgcctgtatacagacctctcattgccatggacaagaatgatatcattgatatatcaaacaaaattgatacctatgagacatcgattcttccgtatgaggactgctgtactattttcgtagcaaagcatcctgttacaaagccgaatataaacaggattaagaagtctgaggaaagacttaacgatgtgatagatgagcttatgaagacagctatagatactacagaagtgattatggtggatgctgagtaatcagtgccaccttagagcaaaataaaaaggacctgagcttcaggtcctaattaatcaaatcattgtgtctgtattacttggcttcgtcgatgatatatggctttaatacttccataatctcgtcaagtccggtttctgtatgtatagcgagctctattggcttagagaggtctaagctgaagatacccataattgatttagcatcaatgacatatctgcccgatattaaatcaaaatcgaaatcaaactgagtaatagcgttaacgaatgattttactttcccaatggaatttaatgaaatctgtactgttttcatattgaaaacctccttaaataactactgtcatatagatagtaatagttttttaaggaaaagtcaattaaataggagtaaaaaaataaaatgaaaaaagcagccttacataatttaggatgtaaagtaaatgcatatgagacagaggccatgcagcatctgcttgaggaggcgggctatgagatagttccattcacacaaaaagctgatgtatatgtcataaatacctgttcagtcaccaacatggctgacagaaaatccagacagatgcttcacaaggcaaagaaaaataatccggactcaatagttgtggcagccggctgctatgtgcagacaagtgaaaaagaggtattaaacgacttatcggtggacatagtcatcggaaatgacagaaagcatgaccttgtaaggctgcttgaggaatactctttggacagtgtaaacgataccgtggacgatataaatgacggaaagcatgattttgaggagctctttatagaccagacaaaggagcacacgagagccttcatcaaggtgcaggacggctgtaatcagttttgcagctattgtatcattccgtatgccagaggacgtgtcagaagccgtaggtttgaaaatgtaatagcagaggttgaaaggctcgcggcaaacggcttcaaggaggttgtgctgacaggtatccatctaagctcatacggtgtggattttgaggaagctacaggccttcttgagctgatacaggcggtgaacgcagtaaagggcatagagcgcatcaggcttgggtcacttgagcctaagattgtgacagagcactttgcgagtgagctttcaaagcttgataaaatctgtcctcatttccatctgtcgcttcagagcggctgtgatgcaacacttaagaggatgaacagaaaatataccactaaagagtacgagagaggctgtgagcttttgcgtaaatattttgttcatccggccatcacaaccgatgtgattgtgggatttcccggtgagacagaggaggagtttgaacagactaaggcatatcttgagcatatacatttttatgagatgcatatctttaagtactcaaagcgaaaaggcacccgcgcagcagtgatgcctgaccagatagatgagcaagttaaggcggcacgaagcgaaaagctcatagcacttggtcatgacatgtctaaggagttcaggaaattctatatcggaaagaatgaggaggtactttttgaggaaaaggccgtaatcggtgataaagaatactttgtcggatatactaaggaatatgtcaaggtcgctaagaaaactgacgaaaaccttgaaaatcagatagtttcaggtcgtatatcgggtatgcttacagacgaaatattactcttcgaataataaaaggttgtaattttattacatttataataaaataatattacaagaagggcgaaacgtatggaaaaaaatattaacaacacacaattttttacagttcaaaaggagcctgagcttcaggtaagcgatgtacttgagattgtgtacaaggcattaaaggaaaagggctacaatcctgttaatcagattgttggatatattatgtccggagatccaacatatatcacaagccacaataacgcgagaagtctcatcatgaaggttgagagagacgagcttgtggaggaggttctcaagacatacattgagaacagcgcatgggattaatatgaggatattaggtcttgattttggttcaaagacagtcggagttgcggtgagcgacgagctcttaatcacagcacagggtgttgagatagtgcgcaggaagtcgccatccaagctcagacagactttggcacgtattgaggagattattgcagagtacaaggtggacaggattgtgctcggctatcctaagaatatgaataacacggaaggagaacgctgcgagaagacgaaggagttcggtgatatgcttgcaaggcgcacaggtcttgaggtcatatactgggatgagcgtcttactacagtcgcagccgaccgttctatgatggaaaccggcatacgcagggagaatcgcaaggagtttgttgatgagatagcagcgatttttattttgcagggatatttggattatctgtcaaatagtcggtcttagtttttatgcagaaaattaaatttactgatccgcagaccaatgatgttgtcgagtttgcggttgaagaagagacaacacttaatggaacacgatatcttttagtttccgaaggagaagaaagcggagactgtgaagcatatattttaaaagaagtaagcacaaaggatgaagaggtgctttatcagatggttgaagacgatgttgagttttcggctattgctaaggtattttctgagcttacggatgatgacactgcacttgaatattaggattgcagttgtacgtgaaataaatttggaggtaatattttgaagaaaacagaaaaacagaatacaggtaagcttaagatcattccacttggaggattagagcagattggaatgaatattactgcctttgagtatgaggacagtattattgtagtagattgcggattatcattccctgaggacgatatgctgggaatagatttggttatccctgatatcacatatcttaaggagaacatcgataaggtcaagggcttctttatcactcatggacatgaggatcatatcggtgctattccttatgtactaaaggagataaatgtaccgatatacgctacaaagcttaccatcggaattattgacagaaagcttgaagagcatggcatgctcaagactgtcaagagaaaagtcgtaaaatatggacagcatatcaaccttggctgcttcagggttgagtttataaagactaaccacagtatccaggatgcagcagcgcttgctatatattcaccggcaggtatagttgtgcatacaggcgatttcaaggtagattatacacctgtatttggagatgcaatcgaccttgcaaggtttggtgagattggaaagaagggcgtgctcgcactcatgtgcgacagtaccaatgcagaaagaccaggcttcacacagtctgagaagtctgtcggaaaggtattggacggcatctttgaggatcacaggaaaaacagaattatcattgctacatttgcatcaaatgtagaccgtgtgcagcagattatcaactgtgcggagaagtatggcagaaaggtggccatcgagggacgaagcatggtaaatatcatttcgatagcctcagagcttggctatctgtcgctgcctgacaatattcttatagatgtagaacagcttagaagctatcctgatgagcagactgtcatcatcacgacaggaagccagggagagtcaatggcagctctttcacgtatggcaaacggtacccacagaaaggtatccataaagccaaacgataccattgtattcagctcaaaccctataccgggaaatgagaagtcggttacaggtatcatcaatgagctcatgatgaagggtgcagatgttatattccaggatgtccatgtttccggccatgcgtgtcaggaggatataaagcttatttattctcttgtcaatccaaagtacgcaatccctgttcatggagagtacaagcatcttgtggcacaggcaaaaatagccgagcagctcggatatgatacagaccacatcaagatcctttcatcaggagatgtgcttgaaatcaatgaggacggtgccaaggtgacaggcagagtgcatgtgggcaatgtcatggtcgatggactcggtgtaggagatgtaggaaatatcgtgctccgtgacagacagcgtctggctgaggacggaatcatcatcgttgtgatgacacttgaggcaggctcaggacagctgcttgcaggtcctgatatagtatcgagaggatttgtatatgtgcgcaattctgagagcctgatggatgaggcgaaatgcgtgctggatgacacaatggagcgtctgacagacaacaatgtgacagactggggcaagataaagacagaggtaaaggatgcattgggagactttgtttggaaggaaacaaagagaagaccgatgattatacctataattatggaagtgtaggaatagcttatggattttaacaaggctttatttggttttataagggttgctttttcaataatgattgctcttttagtgctgtttgcgggcataaaaatctgcagcatctgctatgattttggctacagagtatttactgagcctgctatgacaaacggtgatggtcaggatgtactcgttcaggtggaaaagggcatctccgcagaggagcttggacagcttttagaggacaagggccttgtaagggatcacaatttattttatctccagcttaagctgtctgcttactcaggacatataaagccagggatatacacactcaacacttcaatgacggcaaaggatatgatggtaatcatgtcctccgacaagagcgatgaagaacagacacagactacggagccttcggatacacagtaattatccgttaagcgcatttgtgtcaataatcagattaggaaatacaagaatgatagttgatgagagacttgtcacatatatcaattccttggacagaggcaacacgcctgtattagatgagatagagaaggaagccttaagagacttcgttccgattatcagaaaagagatgcagagctttttaaagctgcttcttgcaatgcaaaaaccaatgcgtattctcgaggtgggaacagcggttggtttttctgccgttttgatggcagagtatgcaccgaaggattgtcagatagtgacgattgaaaattacgaaaaaagaatacctatcgcaaaggccaactttgaaagagccgggaagcaggagcagattacactcttagagggcgatgcaacggagatacttccacagcttgaaggacagtttgacatgatatttatggacgcggcaaaggggcagtatatcaactttatgccgcaggtgcttcgccttttaaagacaggcggggtgctggtgtccgacaatgtgctgcaggatggcgatatcatagaatcgcactatatcgttgagcgcagaaaccgtaccatctacaagcgtatgagggagtatctctacgagcttacacactcagatgagctggtgacggcagtgatgcctataggtgatggaattacggtgtcaacaaagctatagtaaccggtgtagaatatattggatgaatacaaaactgtatgggagaaaaaatgagaaaaatagaattactttgtccggcgagcagcctggaggtacttaagatagcagttatatatggagctgatgcagtttacatcggtggagaggcatttggactaagggccaaggctaagaatttctcaatggaggagatggcagagggagttgcctttgcgcatgctcacggtgtgagagtgtatgttacagccaatattttggctcacaactatgaccttgacggagtgcgtgaatactttacagagcttcacaacatgaagccggacagacctgatgcactgatcattgcagatccggcagttttcatgattgcaaaggaggtctgcccggagatagaaagacatgtcagcacacaggccaacaacacgaactacggcacatatcagttctggtggaatctcggagccagccgcgtggtgacagccagagagctttcgcttaaggagataaaggagataagagggcacatagatgacaggatggagatagagacctttgtgcacggagcaatgtgtatctcatattccggcagatgcctgctttccaactatttcacaggccgtgatgcaaataaaggcgcgtgcacacatccgtgccgctggaaatactctgttgtggaggaaaagcgcccgggtgagtatctgccggtatacgagaatgagcgtggcacatatatcttcaactcaaaggatctgtgcatgatagagcatatcccggatctgattgatgcaggaatagacagctacaagatagagggacgtatgaagacagcactctatgtggcaacagtagcaagaacctaccgcagggcgatagatgattatcttgagtcacctgaaaaatacgaggcaaatatgccatggtacttagagcagataaagagctgtacctacaggcagtttaccactggctttttctacggaaagccttcggaggagactcagatatacgataacaatacttacgagaagggttacacataccttggtatcgtaggtgctccaaatgaaaaaggcctctaccgtatggagcagagaaacaagttctcagttggcgagcagattgaaatcatgaagccaaacggagacaatgtgcttgcaacagtgcttgcgctcgttgatgaggacggcaatgagatggaatcctgcccacatccacagcaggtattctatgtaaagctgtcagagacacctgatgagtttgatattttaagacgtcaggaaaatgaggctatcgctttagattaaaataattgttttttaggaatgaatccgctatactaaattatggtattgcggatttttttcgtaaaaaaatacggattatttgaaaatttgttgaaataataactgaaatacaacagatagtaatggagaaaaaatgttaaaaatagctatatgtgatgatgaaaaagtatttagagataatataaataaatatgttgcagcctatttaaatgaaaaagagatttcttatgaaatagatacattttcatcaggtaaggaaataattgatttaggaattgaaattaaacaatacaacatcatttttttggatattaatatggatgatgttgatggaattgttacggcacaaaaaatcagggaatatagttctgaaatatatattgtatttgtgacagcttatataaattattcgttggagggctacaaggtcgaagccataagatatctgttgaaaaataatactaatttggaggcttccataagcgaatgcatggatgccattcttcataagatgaattttgtagtaaaaaagaaaaaattcaagttcaatgaaggagaaaaggagattaatatagacaatatactatatattgaaagcaaattacataaactgcaattctatatcatggaggataaaatcaaaatctataatttatatggcacattaaatgagctggaaaatgaactaaaagatttccattttattagaatccatcaaagctatttgactaatttgaaatatattaggagtgttaaatgctataaagtactgttatgtaataatcaggaattgctcatacctaaggcaagatataagaatgtgaaggatgcattcatttcatataagggagaattgtgatatatgtttacatactttttcagtttagtaattattatatttgaagcgatatgttgtaatttattttacgatgttttttgcaaagaaaattcgagattaagaaaaagtcaaaaagttttgctgatgctatcattgatttgctgctattatttatgcggattatttttgtctgatatgcttatattgaaaatgacgttggttgtactggctgcagttataattatgagtttttattttgaaattagtataaaaaaatcagtcatttttgcattattatatcaaggattatcaatcatagttgattatatagcttatattagtaataacacaattatttcaaaagcgggtgaggtacaaaaaggatatgcgttagagggaagcttggttgttatttttagcaagattaccgtatttttatgtatcttactgctaaaaaaacactttggaaaaaaatcaatagagactttacctgacaaaatatggggaagatttttgttttttcctgtatttacaataattacaattatagcaatgattatgacgtttcaatatacaaaaaatgaagtgcaggcgaacgttttatattctatctctttgggattggctgtgatgaatatatttgtatatttcctgattaacgatattgtaaccagtgaagctaaattgcatgaaaaggaaatattgggactacagtttaaaaaccaaattgatatgtaccgttctatttcggaaaattatgaaattcagaagaaaaagtcacatgaatttaaaaatcatatattgtgtatagaatctttattgaaagctcatgaatatgacaaggcaagtaaatatgtaagaaatatcagcaatacttttattggagaaaaaaatgtaatcaatacaaatcatgtgataataaatgcgattcttaatacaaagtatcaggaggctatcagtaagaatattgtttttgtgtttaaggtaaatgatttatcaaaaattgtaataaaggatgaggatctggtagtaattttagcaaatctgctaaataatgccattgaagcatgtgaaaaatgtgaggaaaagaaaactataaaactaaagtttgtgatagaggaaaatcttatagttctttcggtgaaaaatacatgcagtcatccaattatttacagtggtaatgaaataaaaacaagtaaaaaagatgaaccggaaatgcatggcattggtataaaaaatattattcaaattgtagaaaaatacaatggcgaatatgttattaaaaatgagaacaatgaatttagtttttctattattatcccattataatatgtgaccatagtttatgtccattttctgcaaaaaatgttcgttttgtgcatggattgttgattttatctattatgttagataaaattataaaaagtaatttgggagtaagataacagaaggaaaaataacaaatgatttataaagtggcaatatgtgatgacgagattaatcagtgcgctgtactcgaaaaagtaataattgaatattttaagaatagagctgaaaaatgcgaggttgaagtatggtatgattctatgtcattatgcagagacataaaagagttcaatccgcagatactttttcttgatattgagttaccgggtgataatggggtttgtgcaggaaaatatataagggaaacgcttcataatgacaggatgaatattgtgtttatttctcataaaacaagctatgctatggagctttttcaaattcatccatatgatttccttataaaaccgatagatgataatgttttgtgtgataccatgactaaaatattacaacttgaagatgtgcagaaaaaagaattcagatatacatataataagacaggatattctattccatatggtgaaattatgttgttttccagtagaaataaaactattactatatgcaaaaccgatggtgaaagtgtatcttattatggaaaacttagtgatattgtatcaaatcttccgtttcagtttgtctgcataagcaagtcatatatagtcaatataaaatgtattaaatcatggaaaagtgatgctgttttactgaaaaatggtatggaaataagtatagcacagtctaaaagggcttcatttaagcaagcagtttttaactatggaaggagtaaggaagtgatatgacttttgaaagagcaatggttattttgtttacaaaggtagctcagactgttattgcagaaagatttactcatactttttttgataatgatggaaacagagtgcgaaaggtatttgcatatttatttagtgtttttatagcgatatttgtaaacttgttttttcataaaccgatatttaatttccttagtattttcttagggctgtcagcaattgctttatcatataatggtacgataaaaagaaaatgtatatttgttttttatattttggcagtaagctgtctcatagatttagtagtaagtgcatttttaataaaaccctttggatatgatggatattcagcttttgtaagtatatttgctcttttattattgcatgctgcacagttgattacagaaagattttttggaaataatttaggcatagaactaaataatcgttattggttgtttattattgcgtctttattagtatgtattatatcatcgatagtaatatttatggataaaaccgtgtcatcattttctctttcgttagtgtgcggagcatttctgcttgtaaatattattatttcatatttgatggatgatcttgttaagtcttctcagaaagctttggaaaatcaggcacttagggatcaagttagttcttatgaaagagagattatgcttcaaaatgaaaatatggaggcattaagatcgtttcgccatgatatgaaacgtcattttgcagagatttcggtgcttgcttcaacaggcgaaataggacagataaaaaattatgtgtcagctatggagaataatcttgtagaatcaaggtaagtacgtaatcatctgtaccttgattatttaaaacatgccgcccatcagggcctcttaccttcgggatcaattcatcaattccggcttttatctcctcacgggatttaccatccgctgccataactgccgccattctgatcacgttgattgatgtcgacatctcacttgatatggaaaagcatatgatctccctaccttcatcaatatatggttgcattacattcattgctgtttctatagatggagctgaagtctttggtgtagtcttatttttatcagcccactcatacaatgcatgaatgtctatctgcggtccatcctccagttcttcatctcattttacaatatgaagcggaataatatctatatcgtatctttctaaaacttcctgtgacagatcacatgtactgtctgatataatttttatcatctttaatacctcgttttctgttgaatccttcatctaagagaactgcaccaatctgtattatttcactggcgtatttatatatttttcttaatgacagctatggcttccgcatccatgctcacccacggtcaaaacaataggtgtgcttttctcttttttccattctatcacaaactcaccattaatcatcaattttttgatatttttctttcccccactgtaaagcagcctctgaacatttcgttatacagagggataaaaataagagcaagatccaccatctacacccacaacttcaacatattcaatatggtgttttttcacagttctatacctccataaaatttactttatcctgactatcagaccactgttcttttgtaagataagtaaagtgctccgttctaacatctcccataagtgtacagggtttattttcttccgtatgatgatatttgaatccacatttttcctgacagcgttttgatttttcatttccgtcataatatccgcaccacatagcactacaacccaaatctaaaaaagcatgcttctgtaaagctcgaactgcttcgggaatcaagccctgcccccagtatggaacacctatccaatatccaatttctatttcatcatcagctgcttttgtgtgcgactgcgctggcgtaatcaatccgatacttccaattgcaacattatcttctcttaaacacactgcatatgtttcatctgctgccaaaacacttttgatgatttctctgctattctctacacttgtatgtactggccatcctgctataggcccaacctctggattttttgcatatttatataaactctctgcatcatcctctttccagggacgaagtattaatctctcagtttctaatgtcataacctactcctttaccaactgctttctaatataatttgtgatcgaatcaaatacgaccggggacattttaacaatccggctccacattcgaattccttgataaactttttttcatgtaaagcacctcctcggcaaacttgaagttgttgatttctttattatctaatctgttagtaatctatccaacagcatctgcctattatttataaacatttctgttacctggtaactctctgtatcctcatattcgcacagatgtatgcgtccattatcaaaacaatagatatctgcatctggtattcctaacaaaattggcgaatgtgtaactataataaactgtgctccctcttttgcacatctgtatatttgcatcaacaatgtaagctgtctctgcggcgataatgcagcttccggctcgtcaaaaagatacaagccatttggattcatattattctgcgccaatgcgagaaaactctctccatgtgatttttcatgatatttagcggaaggatgtgtaatatctgcatattcttcttcctgcgttgcaacattataaaagctttctgccctaagaaaatatccccacttttccttccgatagcctttggcaattcttatcgcatcgcacaactctgaatgtgtatcatgcgtagaaaaaacataattctttgttcctccctcaggattaaaaccatgtgctacggcaagtgcttccaataaagttgatttaccactgccattttctccaacaaaaaaggtgattggtttattgaaatcaagtttttcaattcccttaaaagcctcgattccctttaaataactatcgttatcaattctattccaatcgaatattactctttgtatgaattgattattcatttaattcggcctcaatttcttcaatagtaggcatactacctctgaactcttctggtataagttttgataactcataactagaaataccaagtggctggctagtagattctaatgcatattgggcttctactttatccatatctttacaaatcagaagtcccaaagtaggattatcagcttctgttttcatctgatgattaacagccacaacataagttcccaattgacctgcataagaagaatcaaattttcctgtctttatttctacaacaacataacaatgcctttgagtattgtaaaataacatgtctataaatttttcagtatctcctacctcaattctcacttccctgcccatataagcaaagccagtacctaactccataagaaaattattaactttctctataagtgcatcctttagttccttttcatcatacctttcacgcaaagtcaaaaaatcaaaattatatggatccttcgtaattgcttgtgctaaatcgctctgttctatcggaagtgtgttagtaaagttagttattgctttgccttgacgttcatataaatccgttcctaagaagtttagtaaaacatctcttgaccaattgttttcaatagtctttctgatataaaacaatgcctttgcagaattccctttgcatttatcaagtattattttgttatgtccccatggaattctaaaaatgatttgtaaattatccccaacttggggacgatttgcatctgtaatcaattcgtcctcaacctgaggacaaatcactgcgtcaggatacatctcataaaaatatctcatatatttcaaattagttggagaaaatgatttcacatctggcaaaatggatttcaaatcgtcactcaccgttttatagaatcccgttccatacccgaactgttcgctcatagatgaaatgcccttaccaagtttccaataaaatctcagcatctcatcatttatcttcatagaagccctgatttggctttttctaaaatcagtggatattccggcaatccactctttatattcattatcagccttaatcaattcgctcatatacaatcctttctaatgtgtcagttagaaaaattccgattctaatgtctctattataccataatgatactattataaaaaaggaaaaagagttcattcgagctcttttgagtcagttctgcaaactggaattgagatttcatatattccaagggatttaataactgttatattttattatcaaatatctctcaatcccttgaaaacacaaagtttatcgcaggtgagctttcccttattgtttcccttgcgttatatcgtcccaccagtgtttacgaactctgataaggacaaaaacaagggcaagaaaattatataaaacagtataacacaaaataaaagtgacattgtgaactgattgaaatgcttctgatttttgcaacaaatgattgatttaacgataaggagatttgatacgatgagaacaatatttgcagaatacaatcccaagcgcaacagtattgatgtttacacctctgttggctatatgctccgcattgactgttgggaagctgaaaagaacttaaaaaccacaccaggatcagactgtgcattaaacgcactcgccattgatgaacctcttgaatatgccaaattatatcttgatggaaatttgcagatgtgggtagatgcggaagactcattagatattttttaatttttaaacaaatacaacagtttaaatcgctattaaccacaatatttccggaaaattcatcataggtttgtgcaaatgcaaagaaacggcggctctgaaaatcaaagccgccgtttcataggcgcgtgaaaatgtgtctgctctgcgacggcttttttttttgccgtcgcgctgcagataacctattcgttctattttgaacttcttttatgctacctgatgtctgcaataggaatgaatcgccaagaatgtaaacacaaataattcaattcctgccgaaatcaaaataacatgcggtgtccagaaactcattccaccgatattcagataattgaaatctgcaagctgagaaaggaaattgttctgcataccaattccggcagatggaagtatggtagagagccatgttgctcccatcgctacataagcaaaaagcggcatgagaagaactacaatagagatcagcaaaactgtcaatgtgtctttacattttgcagacaggaacaacgtacagctaaccgttgctaatacagaaagtaagcccgctgctgcgagaattatctgcaactgccccagattgatgtttggcagattaatgatagagtatcgcatctgaaacgatgtttttaagcaatccgtcccgaacgctgcatctaaaatcagaatgtgtatcgtgatcccgacaaggaaagtaacaacgaaaagtgtaaatgccgccagaattttggtaattgctaattgtttatgcccgtatttggtggttcgcaggatgctgtcaccgcccgtttgatattctccggcgaaagtagatgctgcgattgccacacacaaaatagcaaggaacaaaatataaaactcaatataatcaaatgcatcttttgaaattccagaatgaagataaaatggcgtatcaagttctgaatatttttcaagagctttctgctgtgcggtttcgttttctctttgctcattccgcatgacatcctgtaaatgttctgcgcacttttcataataggctccgtcaatgtcattcgggtcaatatccattaaatcagcaccaatgcctgttactggatcagcaaacgcttcggacagacccatcagcaagtgacggaacgggacgattttttcaataaatacagccagaggaaagccctcttcctcgactggcccatattctcgaacgcagctttgataagtttccaaagccgatttgatcctatccggggtcacttcaccagcggatgttttatataaatcttgtttgtacttgatagctgccaagccatctaattctgtaaccgtgccatcttcgtttggacggttaataccctcaaatgaaataggcaggtatgccatggctacggaaagcaaaagtgcgattgcaagtaaaatcagggtgcgccgtgacttcaaaatacgttttagttcaagtctaaagagccgcatattatctgtcctccttttccaagtctgtctgcgggaacaaccacagatacagatcttccaatcgtggctccgttgtaacagccccatcaatttccgaatgttcggacagataacgaatagaaacctgattgtgatcttcgcctcgctgattgataatgcgcagccgcatttcacattccggcagctttgaggtcggaattatgcaattccaaaccttgccctcaatccgcttgacaagttctgcggtagttccgacatcaacaatttctccggctttcataattgcgttgcgcgtagaaatatattctatgtcagatacgatatgggtggaaatcaacacgattcgatcatgcgaaaactcggaaatgaaattccgcagacgcacgcgctccccgggatcaagtcctgctgtcggttcgtccatgacaagtatctccgggtcgttcaacatagcctgcgcaataccaacacgacgcttcatgccgcctgacagattggagatttttttctttttcacatcggagagcgaaagaatgtccaacaaatgattgatcttttgggtggttgcccttgtaggaatatctttcagcgcagccatatactccaaataatctttgaccgtaaaatcccggtgatacccaaaatcctgcggcagaaagccaaacttgcttcggtagacttcacctaactctcgaatgtcttttccgtcatagtaaaccgctccgttggttggtgtcataatatcagcaatcatgcgcatgagcgtggttttccctgcaccattcgcccccaaaagtccccaaacgccgggagtcaatgtcagattgacatcatttactgctgttttgtctttgaactgcttgcttaaatgctctattttcagttccatgcttacactcctttcttttgcttcagctgaacaataaaaagcccttgttcgataatcattgtaccgaacaaaggcttttcaatctcaaaaatcacacgcttaaattcctaagtaattcctaagatcacattcttattttcctaagcggaaagtggtaatgtaatcacaaagtctatggtttcgttttgactggatgcagtaatctttccaccatgtaaatgtataatttcttccgcaatagaaagaccaagtcccgcaccacctgtattagaaagccgagcatcatccaagcgattgaatttttcaaatatactgttaagctgttcctgtggaattgtttttccatgattttcaaaagtgatctgaatatcatgctctaaccgtttggcggatatagtgatttctgtctgcgggtaactatatgacgcagcatttcgtaaaagattactgaaaactctcgccagtttttcagggtcagcgttcacggataagttatcctccgcagtaaataccgctgtattgccatttgcggagagtgtcggatatatttcatctattacctgcgcaatcagacaatgtaaatccacagtttcttttttgataataaccgtatgtgcattgtacttggtaatttcaaaaagttcattgatgagcttttcaaggcgctctgccttattcaacgccacttttacatacttttccttttgctgttcaggcatgtcaggggcttcatggagcaggctcaaatagccgattactgttgtgagaggggtgcgtatatcatgtgccagatacataataatttcatttttcttttcttctgcctgctttgcagcctgcttgctcaacagaacagacattttaatctgattgagctgttcctccagttctttcagtggctcagacaacgatactgtatgattgttctgctcatagaccgtttgggttgcgtcaattacttcatccagatagccccacggctttttccaatagtaattgaagatacatataaagccgagcatcagatacaaaataaaaagcagatcaagccgccagtagagccatgcaaaaataccgttgtcaaattttgaaaagatgtagtccaagataagggtcaaaccatatccaacaacggtataaaccagcaatgataggtataagcgcactttaaggcgcttttctgttgtcatttctttattcgacatgagaatacacctcctaccgattagcaaacagaagaaagccaagcagaccaatcacgacaacacttactatgcctgccagaatggaaaacagtctgtttgcttttattctatttccgattaaccgggctgccatcgaatatacagcaagccccaaaagaccacctgccgtatttgtaagtacatcagtaatatcagaacgtccgactgctaagatatactgcatagtttccaataaaaaacttgttccagcaatcagcatgaacttcacatataattttgttcttggcagaagcatttgaagataaatgcccataggaacaaaaatcaagaaattttcgagtacctctgttaagtgaaatgctgcgccaacttctttgtcatagtgaaaaggaataaggtttatactccttactttatccagatcactgattgaaaactgtagtttgaacagtatgatccaaaccagaagtgccagataaattaagaataaaatagttgccaaacaatttgattttctcttcatagcgttctcctttcgcttaaattttgtagccgacaccccaaatcgttttaatatactgcggagtatcggaagtatcgttcagtttctcgcgcagatgccggatatgcacagtaattgtgctgctgtttttagagtagtattcatctttccaaaccgcatgaaacagttcctcaatgcttacaacatttccagcacttgacaaaaggacgtggagaatagaaaattctgtcggggttagagaaacaggttccccgtctaacagacattcatgggtctgcacattcaagcacaatttgttataggaaagttccgatggaattttctctgtgatgataccgggtgaatatttcttgtaacgtcttaactgcgctttcactctggcaactacttcaagtgggcgaaagggttttgtcacataatcgtccgctcccaatgtcagccccgttattttatccgtttcctcaattttagccgttagcattatgattggataagtgtatttctttcggataagctggcaaagtgaaaagccgttcatatccgggagcataatatccagaatggcaagatcaatgtcgccgctttcaatacacgacatggcatccgttgcgcagtaaaatttataaacgacgtaattttcgtttttcaagtagacctccaacagatccgctatatcttgctcgtcatctataatcaatatcttttcagacatattttcaactcctttgctcatatttccaattaagtatagcaaatacaacatctaaattcacaatggattgcctgagaaattattaagattttcctaactttcgaatttaggcaactcaaaatgctaacgtaatttacatatcagttttttatgtgtcatacatattctccaatatacttccatataatgcacagattgacttcacaattgcatgccatgaaatatcagcagcataagaataatttttttgatatgttttccataaggtctccataaccggacttgattcaatttcatcaaatatttctcttatatcctcagcttctatcaggtctaatgttcccctttttttggctgtagccacaagtgcagtccataaaacttgtttttggagttgttctccatacaacttttgtaaaatataaatatcataaaaatctctcattcgtgtatttgtaacgtttcgactaacaacagtttccaatttttcagccaataccgtttccagattatatgcccatacctcaatagtgcggtcttcaagcataagattaaatttgtacttgatttctcttggtgtaattacatcccctgtagaaatatcaatctttaatggtgtgattacatcatcaaatttcgtttccatgcttacacgaacaccaggataatctgcttcttccatgatttccgatatccgtttgacccgaaatgaaacaccatcgtccagtggaattgatataatttgggatataatcatttctacatcctccacactaacattagtgccttttatggtagcatccagatccatagtagctctggcatccagaccaaccattgccgccacaagcattccaccttttaatataaactggtttttatactctgataaagaaattcgttctaaaaaacgttccatcatataattccgcatcaaaatctgtgcatctgcggattttttctttgacatattacgaattaaatcctttaattgtcttgccgttgttatcatctaaagtaacacctccaaatatggtctaagtatgttttcaacatgaaacatagctgcgtatttcataagcatccgtaagtttttatccttacgttttgcatattgtttcaatgcgtcttgaaagacctgcatttcaacattttttctgctacgaagcagatcacaaattgttctctccatgtcataaacgggaacggaatgtccgaatgatgtctgcatagctatgattcctatttcatgtaaatccttttttactgtgtacacttgaaaaccgtcttcctgcaaacgacttggattatatccagttcttactgttatggtgtatttcaaaggctctctgtccgttaaatcatgaaaaaacaatgcagtttcatgagaaaatacagcttgaccacaacgtaaatgcaaaaggtacattgcatctgtccacgtatccggcgatacatacacaccatgagcagcttgttctaatcctcgttccttcacatatgcataaaacacagacttactaattccattatttagaacttgaaatgtctgaattgtccctccacattcacgcaacaacaaatctaatttttcaaactgagtcatatgctttctcctttcgtgctaatatgataatatatattagcacgaaagtaaaggcatatagtaccaataaaatatcggtatttttgttttaatgatatccccttgtttctcgccatccctttacataccacctgattccaacatataccagttgcacgaataataagagaaatagcagattgattggcaatgttgtctttatccacttcccaaagtagatagctgttgccatgcttataagtattaccattatggtaatcatatcccaacagcacttcttatataactctgcaatctttatctctataaatgctacaagtattccagcacccaccaaacatccaccgcagatcagtattcttatcagccaatatacaattccggcaacgacaggattggatattccattactaatctgtgccatgttctttcctgtcagtataatccaccctgcaatggtctgtataaaagtggcgattgtatcaaagaataccacgcaatcagaaataaatatttttgaccgtatcatctgaaaaagagtagttgatacggaataccatatcagcagaaacatcaatgcttcatacatggctgtttttgttttatatctgcctgccagtttttctctctgcgtatcatacttttccttggctttcagataagctgtcaggttacagttcccacacttttgatagagtactggcttttcaaccggtatctctacttttttctgatgagagagtgcatagtcccgttcctgttctgcctgccttagcttatcttgacattcctctgtcatgatttcggcagcgtgcgttttctctttctctctctgcaacaattcttttgttttcctcaagtcgttctttaaggcttgaatgttccctgctctgttctcgctgtttaacctctcgttcaaggtcagcgattcgtcgagctgcattttcagttcccggatagtcctgtctttctggtcgagttcttcctgcatctgctctgtcagcagaagcaactcttccagttgatcgtcgctctttgagtttcttaattcgttcatcaatcgaccttcctttctctaattgctgttcaagttcagtaattcgctgttctgtttctgcaatagccggttctcgctgtttaatttctgtgccaattcctgccattgctgattttcgtctgtaagcttctgtatctggtctgtcttttcttccagaagtatcaacagttcttctgtatccggcaagatttgaagcagttctgataattcgctctctaattgctgcaatcgttcttccttctcctgaaagcacatcagcttctcgtccttttcctgtatttcctgaagcatctctgccatgatattctgctgttcctctatctgtgtaatcattgcttccatcatgggaattacttctttgctttcttctaatgtcattcaaccactccttccatattgacaatgcaccggataccttaccaaaggttgtgattaccttttgcagtagtgcattttgttttttaatcatctggttttcctctaccttccatgaaccattccatatctgtccggtgagatatttttcctcaatctttcttgcatccgcaccctcatgaatcgtagggatttttaatttgccctgtctttcataagagcggtggtcaatctgattgtctatggataaatgccggttacacatcccagcccattcgcttcgccataactcacaattctttggattattccagccggtagcatcggtcagaacccgttcccattgttttcggtttcttgccccgactttctgtactccgttttcatcaagtaccggaatgcggattccatgccggtcaggatttttcttatcctgccaccagtccgggtgggattcatcaaccacgatatttccgtcagtatctctgacaaaatcccagtccttgacttctttgctgccccatgaatgatccagattgaatggtcgcatggttacaagtaaatgcacatgtgggtttccatcgcccttatcgtgtatgctccagtcgacacacattcccttatccacgaaagtcttttgaatatattcggttgtataatcaatctgttcctgtctgctccattctttcggcagggaaaattcaaatgagcgtccaagctgtgcatctgcatttttttctatcttcaatacctcattccatagacgctgtttctgaaatgtgattttaaacttttccagtgcggcatctttatcatccgctcttttataacggatagactgttgaaacctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattccccctttctgccgtatccggcattgatttccgacagcatcttcttctggtttggcagaagtgaagctgtcggaacgccctctgcgcaagagtgccccctgcggcatgagcaggtctggctgaaagccccgccgacggaacgagcccggcaagcgtaagcgcagaccggttaccacttgtggcaaacttataaggacgacctctggttgtccataagtgcgcccttcattcaaaggcaatgaagggaatggaaaaaccactccctccgccattacacttcctccatatctgtaagtggctctttctgcatcgcctttgagaaaaactttccgtttgtttcctgcctttttaagaagcctatcaactttggtaaatcttcctccccaatcggacagccaagaaccgattccactgcgccaccaatctgacagagcctgtgggttcgttttttactttcctctgctttctttcgcttttccagttccttccgctgtgcaatgagcttttttgtagcttcaatgctttcctgttcctttttctctaatgcacgtattctttcttcataagtctttgttgatttcgccatatcgtcttcatcctttctttttccgataaacaacagttcccggttgcatatcaggagaagcacatggtataatcctcttgcgtgtaggtatatcatggcttcggtctgatagaacctttggcggtttcttaggaagccgcctttttaagttgccacatttcttgtgacagcttttacatttcctttatccctcagatcacgcccctcgttggcttccatgaacttttccagaatgtcagttttaataaggacttttcttccgacctttaataccggaagcttcttccattcaaccagctttctcaaagtgtttctgccaattcctgtatagtcggctgcttcctcgatggataatgcaatctttctttccgtcatcttgtcacctccttataaattgcattatgcaattttgttgtgctgttagtatagcggctttatattgtgttgtcaagcgttatgaaattttaaaaataattattatattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagcaaaagtgaaacggaaaaactgctccgtcaggcaatggacgattacgaaagcaagaaattcattgcaaagtcggaaaatattacagttggagaattacttgatatatgggcagaggaagaattaaagaccggtactctcagtaatgggacagtccagaattaccttggtgctattaccaacatcaagaagcatccaatttcagagagaaagttgaaaaatgtaacatctgagcatttacaagccttcttcgatctgctttcctttggtggcacttatccagatggttcagaaagaaaaggttacagcaaagattacattcgttctttctcggcagtattacagcagtcattccggtttgcagtatcaccaaagcaatatatcactttcaatccgatgcagtatattaagctgaaataccagacggatgaggttgacctgttttctgatgatgacatggatggcgatatacagccaattccacgagaggattatgaaagactgattgaatttctacaggattacaatccaccggcaatacttccaatccagatagcttattatgcaggacttcgtatcggtgaagcctgtggtctggcatggcaggatgtaaatcttgaagaacagtgccttacgatcagacgcagtatccgatatgatggttcaaggcacaagaatatcatcggaccaaccaaacgaaaaaaggtaaggattgttgattttggagatacactggcagagattcttcgcaatgcccgaaaggaacaacttaaaaaccgaatgcagtacggagaactttaccacaaaaactactacagagaagtaaaagacaaaaacagagtttactatgagttctatcatctggacggaacagagaatgttccagaagattataaggaaatatcctttgtctgcttaagaccggatggaagtttggaactgccaagcacgttaggaattgtttgcaggaagattgctcagaaactggatggatttgaaggatttcattttcaccagttgcgacacacctacacaagcaaccttctggcaaatggagcagctccgaaagatgtacaggaactgttaggacactcagatgtcagtaccacaatgaatgtctacgcccattccacaagaaaagccaagcgggaatccgcaaagttacttgataaagtggcaggcaacgactaaataaaactttcccttatttcccttacgattatctcataagggcaaaaataagggaaaatacatatcatttcactaatgaatgggctgaaaagcctgtaaaatagggaaagttagaaagatatttcggcaaacttgaatttatctattcgcataatcaatcaaaatctttttgcaactactgcaacgataagcttcacaatgagggattccgcctgaacctttactcaattccaaatcgtccgattgtttaatacgaaaaacttttgtcacattatcaactgcaaaagtaatgtctcgtgagctcatcaggtatcctcttatcatttcttcaccacaatatggacatttcatgctgctttacctcctataaattccgatttctcagtttcaaaaactgggagttgtttaactgattctataatgtcctatgatatcatcacgatgttccagtatatcctcttcataatatatttgatatgggtttgcatgatgaataacaaaacatataccttttcgatttctcttgtcagatataatgccgatatgttttttaaatacaacaatatctccaccttgccattcctctatttcatttatatctgtagtaagacttattgcattattatcgaaatatacttttaagtttttaactcttctaaaatctatatttttatcaacggcatctatatcatataattctttattgttttttatatcctcatttactaataccatcaaatcatatcctgcatcttttaaagcaaaagctactacatcagtacaaaccccatattcatcatctggataacctgtgttgtaatatttgcttttatattttggattagtttttatgtaattatttgcattatttaatatatctgtttggtcatctatgccatcattgtctttatcaatattgctcttgtaagcttctatattgaaatctgcatttgtatattttttatgtggaatataattaaaacaatacaacacatataaagcaacaattattagcaccgaaaaaacaataagcgttattctcttcttcatacattctccattaaacaacttgcgagttaccaatttcattaaataataaattagctactttttcctctaataacggaaatgggaaattgctaaacttttccaatacagttctattcatttcttcaccacttgcacttaaaagtattccaaatagaataactgaaatactttattcgtgaatttccaagggtagattgtccggatcatgaaagaatgtcatttttttgcctgtgtaagtatcgagtctaatcggctcagttatgatgccccttttattcaattctcttacagtatcatcgaccgagtctacagcaaaggcaagatgcctgagaccgtaagcctctggataacttggacgcttcggacaatttttaatgataaaaagttctaattctatctcatcgagttgaagatcaattttgtaatcatcacgttccggtctgtaattttctcgaataatagaaaatcctaacagatccacataaaagtgctttgatttctcatagttgctcccaataatggcaatgtgatgaactttttttaaattcatggtgtatttacctctctcctactttgtttgaatacatgaaataatgtatcacaatgatactattttgtaatatattttctcaaaagcttatatgtattctccacgccatccatatgtgagcgctcatagttatgcgatgcataaactcctgcaccgataagcccatgacggatatcatatccgctgtgcagtgttgcctcaacatcagagccatagtgcggataaacatcgattgcatagtcaagcccctcgctctttgccaggtttgaaagctctgtgacaagctcgtagttgtaaggtccgcctgagtccttcgcacagattgaaaccatatgctccgtacagccgaggtcggctccaacgcagcccatgtctacggaaatcatctcctccgtatcagccggtacaaagcttccgccatggcctacctcctcataaaccgtaaaaagcagtgtgaccttgcggtttatcttccagccctcctcctttacggcatgagccacaccgagtaagatggcggctgacagcttatcatcaaggaaacggctcttgatatagccactctccgtgatgactgtacgtggatccatggcgataatatcccctgtctggatgccaagtgccgctacgccctgcttgtcatttacattttcatcgagcaggatttccatattctcttcctttatctcgaccttttcatctgccacatgtgccgatggctctgtatttagcaccacgcctgtgtacattctgccatcacgcgtgaaaaccatgcagttctctccatcggctgtgctccactgatgaccaccgatagttgtcgggcgcagacgtccgttatcctttattgagcgaaccatggctccaagtgtgtccacatgcgctgccaataccaaaggtgctccaactccaccgatttccacgctgacatttcctttatttgaaagctgtggcgcatatcccatagcctcaagctgcttcatcagatagtctgtggcattttttgtgaaacctgtagggcttgctattgatgtgagtgctttgagctgtgttccgatatattctttaatctcttctgttaacataattgttatctcccgttttgttgtctttattaattcaattgcattataacatctcatatttgcgcatgcaatccgtattaacccttatttgtagtactctattcgcaagccgcgggtaccatggcgcacacactattccacgaaagcgaatagcgaagctgcttagagactgtagaattgtgctatgtaacgcagaaatgccgaggcatggacgccgaggcaaggagaaatcgagccatggatggcgagtttcgacggtttcgtcaaattaagaaaacctttggcacaattcgtacagtctcttagctgcgtagcgtagcgaacgtgggatagtgtgtgcgccatggtacccgcggcttgcgaacaacagacaacaatttatggtcaatccacttgcgattaacctgcaacaatgctattcttaggatatgaatacacagaatatatataataataaagatataaatacaaaaataaatttagatacaaattccaacacaaaaataaaaatctgcggtctgacttcacctgccgaagcacggtatctcaacgaaaatcacgttgatttcgcgggaatggtgttattttttccaaagagtaagagaaatatatccatcgaacaggcaatggagattatggcagcccttgatgcttccatcaaaagagtcgccgttgtcgtttcgccatccatagagcaggtcagacagattgaggctgcaggctttgactatatccagatacatggggaaattccggagacagaggcggaggcagcaaaagctatcccgattcttaaagccttcaatgtctctgatatggacagctatgaaaagtatcacaacgattcacgcatcgcaggctatgtgtttgatgccatcgaacccggcagtggaaaaacctttgactggaagctggttgacaatattccccgcgatgaaaagctgctgctgctcgcaggtggcttaaatccagacaatgtgcgcatggcaattgaagccgtgcatcctgacggagtcgatgtatcatcaggtgtggaaaatgatgacaaagcggggaagaatccggacaagatacatgattttgttgcggcaataaaatcataaaaaaatccacatacatctctttcatcatgatgtatgtggattttttttatgaaattatgtaactattatttttctttgccaatcttgaaaaacagattagccttgatgagcaccggtctcagtgccatatacacgattgtcgcagcaatcactgatatcactgcattgactcctgttgtggtcacgctccatgcgattttgagctgtgccatcggctttccgaggataagcatatcgtagaaatagcttataattggatcaaaaataaagttgaagagcattcctgcacatgctgcaaggactgtccatttaaatacatgcttcttgtctgttgaatatgtaatctttccaagcttgtgtgctacaagaccggtgataataccaatcataagcttgaggaaaaatgtctttggtgctccggtgatatatatcgggtcaagtaaatcaccgattgtcattccgattgctccaccgattcctccgtatactccgcctaagagcaaagctgcaagtactacgactgcgttgccaaggtgaaaggatgtggcgctgccacccggtaatgtgaccttaatctgtaaaaatgtgaatatgacatatgataaagctgccataagtgctgtaagtgtgagtttttgaactttttcgtttctcataaaatgcctcctaaatattacaattaaactatataatactcttatgtggcatcaagtatatatccaattttatataaatttatatatccagtttatctaaagtccatttactcctgtggtttaatgctgccatagtgttttttcagcatttctattatcacctgctggctctgcttcgaatgggtgatagcgtaatagcttccaccaaattttgccttgcgctcttcctcatctatccctacgcttcgtcctttttcggtgacacgctttatcttgttcccgtcttctgtaacttcctccagatatccctctgcaataagaagctcgtttataaacgaggctgcaagctttttgtgctccttatccgcggggcacagctcatttattttgtttgtaagctctgtaagcctgcatttgtcggtgagttctacctcatcaagcctctgtggctcgatgtaaaacggaagcttcttttttctcgtgctgccggtttcagcagcctcctcatcgcttaaaacagtctgtggtctttcaccggtcgtgctgcctgatggatttgggttatctgcaacaaatgaatttaccgccatcacaaatgcttcaccataattttgtatcttctgctcacccattccatacacatcggcaagctgctccttatcccgcggcagctttgcgcacatatcctttaaggtcttgtcagagcagatgatatacggtggcaccgacttttctgcagcaagctctgtacgcacgctgcgcagcttttcaaacagcgcagcaccaagctcgttaagccctgcaagctgtgctgcctttttgcgctttttgccggtttcaacgtatgtctcctcctcttcatcctccacaaccgcacagttgctgcatttgttgcagatgcatggcgttgtatctccgaaatatgaaagtataaactctctcaggcatttgtccgtctcacagtaatttatcatctgctgcagcttcctcctgtcattggctgtcttttgcatgtcggatgccacatcgcctgctgaagccttattctgcagaaggaacttgtttatcatgatatcctgctttgagaaaaacagcacacattccgcttcctcaccgtctcgccccgctcttccggcctcctgatagtaatactcgaggctctgtggcatattgtaatgcagcacatatctcacatttgacttgtcgattcccattccaaatgcgtttgtggcaaccatcacacggattctgtcgtatgtaaaatcctcctgattctgcttacgttcctcattggaaagccctgcgtggtaacgtcccgccgaaatgccctgctcatttaaaagagtatacagcttatccacattctttttcgttgcgcagtatattattccactttcgtcctcatgctttttcacataattgatgatactgttgtccttctggctgcctccctttcttgtaacaaccctgaaaaacaggttaggtctgtcaaaccctgtcaccatagtgaccggattgttaagtccaagcgaagccactatatcatttttcacgcgctccgtggcggtcgctgtaaacgcactgactatcggtcgtcttggaagtctcgttaaaaatccggcaatttccagatagctcggtctgaaatcctgtccccactgcgatatacagtgtgcctcatcaactgtcagcattgatatgtccgcgttgcaggcaaaatccagaaaacgcggcgtgttgaggcgctccggagcgacatagattatcttgtatcgcccctgtgaggcatacgaaagtgccatccttatctggttttcggtcagtgagctgttgatataggcggcatgcactcctgcctggtttaaagccttgacctgatctgacataagcgagataagtggcgaaatgacaagcgtaattcctttaagcataagcgccggaagctggtagcacagcgattttcctgcgcctgtcggcatgataccgagcacatcgtgccctgcaagtatgccgtttatgagctcctcctgccctgttctaagactgtcgtagccaaagtattgtttgagtgtctggtttatgttcatttatgcttgttgtcctcccttagctgcacgataatcctgtagacctcaggccttctctccttcagatgcttatcaagcaggtgtctcctctgtgcaaaccgctctgcaagctccggatgctctcttgctatacgctcatgcacctcgcgacggtgcatctcgatatctgccgcaagcgtgtgcacatcctttcctgatatgttgacgatttctttcagatgctcctccagatgctccagccactcatcctggtcaaactcatccatatgcgcccagcggccatgcatgatttcctctatatcctttgtctttttgagctgttctatctgaagctttatctgcttttcaatctgctcctcactctcggcgccaaacgcccagacaaactcctgcactctgttgtcagcacgctttcttgaggcactgcgctcctcgttatctacgccaccctcaagcggataaggtctgtttattcccatatcctttagcgcaatatgtattgtccttctgacacagccctgctcaattaaatagcctaagcccagcttcctgagttgctcgttgagctctgcaatgtgccctgttatgtatagctttacacctttttgtttcagtgagcggtaaagtgactctatgctgtcagctcctgtgatatcaatacttccgatagctccggcatcgattatgacagcttttgtatcatgctttaggtggtcctcaatatcgcgcacaagtacctttgcatttgcaaaaaacaggccgctcgaaaatctgtaaataatcacaccgtcaatctcgtggatgtttgtgctctccctgatatcgcggaaatgactgtgtcccggctgcacaccgagaaagcaggtggccggctttgcgcttctgattatcatctcggcaaaagacaaaatgattcctatcaaaactccgtttatcgtacccagaataagtactccgaaaaaagcaccaacaaatatgaaaaattctgtcctgctgaccttccacagtctctttgccagatgaaactccgtggcacccatgagcgctgatatgacaatcgccgtgagcaccggaaccggcagatatcctataaagcctgtgcaaaaaagaagcactgctatcatggaaacgcctgcaacaagccctgtgagctgtgtcttaccctcgtactgctcgctcatcgcagttcgtgacactgaaccgtttatcggacagcagcccgtaaaagccgcagccatatttcctatggaaaatgccaaaagctccgtgttatcatctattctgtatccgtttttctgtgcgaaattgttttctgccagaagtgtctctgccatgatgacaacagcaaccgaaagacttaaaactattacctctgaggccttttgaactgaaaaaactgcctcgaaatccggtatataccaccgcggcatgccgggctcaactgctgaaagagtcggcactccccactcctttaccggtccaaaatatgtaaaaagcgcgcctgttaccatgagcacaaccgccataggaaactttggaacaagcctcttactcacaaccaaaatggcaagcgctacaatccccatgacaagtgcggctgcatttatgtggtgtaaggcctcccatatatgctcagacagttcaaaaagctctccggttcctgccgcagagcccatgagctttggcgcctgcatcagtatgattgtagtacatatgcctgtgataaatccgcccataaccggcgcagatatgtagttcaccagctttccggcattcatgaagtaaaatgccaaaagccacagtgccacaaaaaatgtaaacaccggtacaaccgtcatggcctctttgcttcctgcctctattcccatgccaagcactgctgctccgacaagcgccgccggagcagcatccacaccgaatataaactgcggtgatgtggaaaacagagcaaacaatatgattgggaataccgagccatacaagccatataccgccggtagcccggatatctgcgcatagcccatcgatataggaatcgaaaccgccatgatgatgattcccgcaagaatgtcctttgggagatttttcttgtcgtagtttttgagtgttggtgcaactgataatttttgtttcatttagatttgtgccttctttatcaatactttctttccttcaaatgcgaaaccataatgttgaattgcttctcttttatatcctcgttccaaaagctttgcatcataatttttctcttcaatctgcttcaaagcactatccgcagtcatatccagtgatgtctcctcttgcgaatcaataaccttaaattctattattacagcctgcgaatttttatcacgtggaatgatcatcacatcatatctgccatagccactttcacggtttgactgcacttcatatttatctctaagctcgaccagcaggcctaagacaaaaccatgataaaatctctccggttcagattttcccgaaggatgctttccgctgtcaaagctgctgaaggtagataaagcgacctcattcatgtatatgttcatttcctttacattgcctctaagcaatgcccttatgaatccattataattcgaaacagaggcattaaaccatcctctgaacatatttgaaaacatacttacggtttcaagatttgtaatgctcagatgataccacggttcaagcgtaagacctcttttttctaaggaatcaacctttaaataaccgctggcaagcaaaagactccaaatggcattttcatcgttatcgagctgttcaaacaccagttgttcgtcaatgctaacctccacagaatcgccttccagaagtgtttccatcatagattttatttctgcagatgctgttctgatcaaacgatttaccagaccgtttgagctggtagatgcccagtatggacttatctgtttttcctttagaaaattcgttatagaccatggattataaatatcactgtgatttccaaatttaaaaccgtcataccatttttttacagtatctttttcaccggacagaccatactcttccattgcatcaaaaacttcattctctgtaaatccaaagctcgttgcataactgcttgaggtcgtggttattacattcagattattgaggtctgaaaaaattgattcctttgatacacgcgtgattcctgtcataatagcacgctccatatacggatttgtcttgaacgttgcattaaacaggcttcttatatatgcagtaaactcattccaatatccatgaagatatgcctcctgtataggagtatcatactcatcaaggataattatcgtcttctttccccagtaacgatgaaaatactcacacaaaatatttaattttaatccactctcagcatcacccatcctggtatttgttccttcaaaatcagctatttcgtctgctgtcagagtatccccctcaagcagatatctgtgccttttgtaaacagcctctatctgtgcttttatctggatttttgcatctcccagattgtcggccttaaccgaagcaaagctcataaaaatcacaggataagtaccctgaatttttcgatagtcctcatcctcccatatagacaatgaatcaaacaaatcgctcctgtccttatactgatttgaaaaaaagcagttaagcatgctcatattaagtgtttttccaaaacgcctcggacgcgtgatgagagtcacatcatcctttgaatcccaccattcctttataaagctcgttttgtccacaaaaaagcaattatcttctataacagaagcaaaatcctgtttcccaataccaatcgtttttaccatatctgactccctgtatagtctcaaatcattgttttatatatgatattatagccaatacaattatgcactgcaagaaacaaatatactcttcttaatcacgtttttaaacatagattaagaagagtataatctcttttatcgtattaaattataactacttaattacagcctcaacctcacccttctcaggcatcacgcgaagtgcgccctttctcgtagtaataagagaggctgccgcatttgcgaatgtgagcatctttttcacatcgtcatccttccggtcattgataccatgctccaacacatcgtgaagcaggcatgcacagaaggtatctcctgcacctgtagtctcgacagtgtcatctcgcaggaacggagctgcctccacgatatgtccgtcaaaaaatgccatacttccgtttttgcccatggtggcacagataaacggaatgtgatactcatctattagcttcttcacacctgtctttatgtccttttcgcctgtcatgaattcaatctcatcatcagatatttttaagatgtcacactgactcaggccccagcttatcttctcttttgcatcgtccatgctcttccagagcggtttgcgcagattagggtcaaaggaaatcagtacgcctgcctcttttgcggcagctattgcatgctttgtcgcattctcacagatcttatctgtcattgaaagacttccgaagtggaaaatttttgcgtttctcacaagggataaatccacctcatccgctgtcagcatcatatctgctcccggatttctgtaaaatgagaaatctctgtctccgtctgctgcggtctggacaaatgcaagagtggtatggacattatcatcatagcgcacgcctgttgtgtcgatgccctgctcctttacggcatcaacaagcagccttccgaacgcatcctgtcccacttttccgatgaaagcagtctgatgaccgagcttttgaagcatggcaagcacgttacatggagctccacccggattagcctcaaaaagcttattgtcctgcgcacttgtaccgttttctgtaaaatctataagtaattcacctaatgcaactacatccatattgtacctctttctttcctgtcaaaatatcctgtatattattctacaaataaccggaccaataatttgtccggttattatttgtatgctctactgatatgctttcatattataaaattatatcatattatatcatatttttcaatatccacaacagcacttccgtcacaattaaagctgattccgtctgcctgaagaggtgtacagatagctgtggttgcaacctgctgtccgtcattgataaagagctctatagactgtctgtctatgatgaaacgaagctttagctttctgtctgtatctacaattttaatttttctgacacagacaacatcctttgtgacgccacagcaggtacgatcaatctcgagcacgcctgcgactctgttgtaggtaaacgctgtgctatactcatcatcgcatgccatttcaacagtgaagtcatggtactcctcgcctgaaagctccactgtcatgtcgagagtgcgaccctttatgccatcaaaggtcgtgtagcagtctatttttttatctgtataatgacacttgtttgcacgataattttctatttccttaaccggcttctgccagatacggccgtcctttatttcaagctcacgaggcagtgtcatcatgccctgccaatcctgcgaatcaggaacgacacatgcatcccatgacttcatccaggcaatcatcacgcggcgtccgtccggaagcagtgtagtctgcggtgcataaaagtccatgccatagtcaagtgtgtgcggctcttccttgataaatacatgattttctttatcataatcccccagaaaatatacagagttgtgtccgttatgaaactcatatttgtctgccttcatactctgcggtgaacagatgagcacatgcttatcctccagcccaaagaagtccgggcactcccacatggtacctattttgccggtgctgtttgccgcaaggattgtctcaaactgccaatcggtcaggttttttgaagagcagagcactacctgtcccacattgtttaagtccttgcttccaactataagataatatgtgtcatcctctttccatattttcgggtcacggaaatcgattctgctgcagttttcaggaagcatatcgcctgtcacaacaggattattctcatgcttcacataattaagtccgtctccaaatgcgatgcactggttctgtctctcctgctcactgccgtcaggaagtttaatccttgtgacacctgtgtatacaagcacatgcttaccatctgcctcaatggcacttcctgagaaacatccttttttatcatattcctcatcaggtgccagagcacacggaagctgctcccacttaatcatatcgcttgtcgtactatgcccccaatgcataggtccccactcacgcagatatggatagtactgataaaacagatgaatttttccgttatagacagaaaatccattcggatcattaatccatcctgccggtgcactgatatgaaacaaaggtttactctctttatctgtagcagctattttttttgcctcgtagcttcttgctttttccaataattcgctcattcaaatcctccaattctgtttgctttgccggtaatacagaattatgaacagtaacctatttgccctctgacgtactctcaagggatttctgatagctgtcaaaatatttctgctttatcttcagataatcctgtaaaccatatttgttaagtttcttaaggtatgaatcccattccttatcaatgccgccgtttaatatccagtcggcctttttctgctcagcatatttcttgatgtctgtgtcgtactgtgacaccttgtttgtgtcatctatgctcatgaacacgtttggatagacatacttactgttcatgtccttcagataagcctcatgcatgttgtcaagacgccacttggcatctgcaggctctgtcacataaacatcgtagtaatcgtttaaaacagcaagcggtccgtttactgactgtgcctcacgcacttcaaccggtgactgatcgcccagatccatatgctttaacatctgtccgccgtcagcgtttgtactcatctcaaatatattgaacgaatctttctcgccgtatgttccccagttattctgtggagactggattggagcatacatctgatcaatccacgcggctgccaaagccgtatccctgcagcttgatgtcagtacgcatcgtcctctgtcaaatccactggtctcactgttgttctgtctggttatgtttctgactccatccggtcctgtgagagcaggaagcatgacataatctgtgttgttatcgatatttgcaatgtcccatgtaaagcagagcccgtatctgtggtttttaccctttgctacgtaggttgaccactcctgtgtaaatgcctcagggtcaatcaaatcctctgtgacaagcttgtgaagccactcgataccctccttgtagccctcctgtgtcggagcatagatgacttttccctcatctgttaccgcaaagtggtcacctgtatcaccataaccctcaccaaagccgttcatgaggatggctggatcctggtcaccgttgtttataataaatgacataggaatgacaccgccctcaatgtcaaactctttctcaagctcgtctgcatgatctctgaatgcgataagcacctgctcgagctcgtctgtggtagtcggcacctcaagtcccagataatcaagccatttcttgttgatataaggtatatctccgattgcctgaattgcctcttttcctgcaccaagctgctctatccaaggaaatgaatagatatgtccgtccggtgcggtacacattgtcctatattcaggatatttctcaaaaactgcctgaagattaggcatatatttatcgatcagattctcaaccggaatgataataccctgctttgcatatctgagcaggtcgtaatcactcatacctgcattaaacagtccatccggcagattaccaaactgcgccaatgccagattcttcttgtcagagaactggtctgaaacgaagcatgtccagtcgatatgcacgttggtctgcttctccattctcttgaagatagtcctctcattaggatcctgtgtggatgtggccggtgcacttgtgataaatgacagctcagccttctccttcagaggaaactgcacatctgataccggtgtgtccggatttgtctcggcatttaagctctgctgctttccacagcctgccacacctgtcagcattgcaagtgtaagcgaaagtgtaattaattttttgaagcttctttttttcatatccatactcatcctttctgttagcccttaacagatccaaccatgattcctttatcaaaatatttctggaaaaatggatacataatcaaaagtggtaaacttgatacaacaattgtagcgtacttgagctgttctgcaacctttgccatctcagctgtactttggatatctgcaatcatgcccggctgaggtgtattctgcacgagaattgaacgcagtacaagctgtaatggctggagatttgcgtcattcaggtaaatcattgcatcaaagtagctgttccacattcctacaaatgaccaaagcataagcaccgcaataatcggcttacaaaccggaagcataatcttaaagaaatgctgtatttcatttgctccgtcgatggctgatgcctcacgaagctcatttggcactgactgataataggttctcgccaaaatcatattccacacattgaaagcgcccggaatgaggattgcccatacggtgtttaccatatggagctgatttataaggatgaatgtaggaatcattcctcctccaaaaaacattgtgataataaaaatcacattgaaaaattttcttccgacaaattcctttttagacatcggatacgctgccaggattgtgacaaatactgagattgccgcaaacgctattgagtaaaaaaacgaattaaaaaatccgcgccatatcatgtcattttccagaactcgtctgtatgcatcaatagtccagtcctttatgttgaagctcagtccctgattgttaagtactgtcggatccatgaaagatgccagcactacatatactaacggaacaattattgcaagcacaaacaacccaagaagagtatatccaattccaagaacaattttatcagtccgtgaatatttgatttttatcgtcatatctttttccattgcactttcctcctagattccttcaccatcgtttagcttctttacaaccgcattgactataatcagcaatattacgttgattaccgagttgaaaagaccaaccgctgttgaataaccatagtctccattcaaaagtccgattctgtatacatatgtagaaagaatttccgatgccggtaagttcatatctgtctgtaacgcataggctttctcgaaaccgatactcataatatttcctgcctgcaggatgaactgtatcactataatattcttaatagccggaagctcaacataccacatctgctggaagatgtttgctccatccattctcgctgcctcttcaagctccttgctcgcattggataatgccgctgtgtacatgattgaagcccagcctgctccctgccagatgccgctcgctatgtagattgtcctgaatgcagccggcattgtcatccagtttgtgctgatgccgagtatcttattcattggtccgattggtgataaaaacatacgaaccataccacaaagtacaataactgagataaaattcggtgcgtaaatcagaagctgtatctttttcttgatgccctctttgcgaatacgattcagaagcagtgcaagtataatcggtaccggaaatccccataacaatccgtaaatacttacctttaacgtattcataaggtagttcataaaatcaggtgatgataaaaatctcttgaaatattcaagcccgacccatggactccccagcacaccctttatgacattgtaatccttgaatgctatgagcagtccgcccatcggaacatacttgaatataattgtcagtaaaagtgccggcataaggaaaaatatgtacaacatccagtttttcttcacatatgtcactttgcttttctatgactgctttttttctttcatttgctgtgacctccactctctttcacattttgtcttttttacttaatttacgctcttgtgtaaccggtaaagtaaccggttactttataatttgataatacaatatcatttgtgctgtgtcaatacttttctcaaaaaaagtaaccggttacttttttgttgatattttggaaattgcgctgtatactgtttataaacatttgtaatataagtaatttttataaggagacatcccatgggaaaaaaacaggttacatttgcagatattgcggaatatacacacttttcaaaaacaacgatttcaagatatttcaatcatccggactctctgacactgaagaatcaggaaaagatttcccgtgcgcttgatgagctcggctataagaagaataagctcgcaaaggttctcgcaaacggtaagagcgagtttgtcggcataatagtgccaaacctttacctgcactactactctgagatgctcacacagcttttagccacctacactgactatcactataagtttctcatctttatgagtgacaagggggcggctgaggaagaaaactacattgatgaacttttagcttatcagatagagggtcttatcgtgctaagtcacactctctcatctgaaaagcttgcttcataccacattccaattgtcgcaatcgagcgagaatccatgcatataagcagtgtcacctccgacaactatatgggtgcgcttcaggccacatctcttttaatacgtgacaaatgtgatattctcatccatatcaatgtagatgtgccaaagtatgtcccggcatacgacagaatccgtgcgtttgaggacacctgtaccgagcacaatattccctatgagctcagcctgaacgtatccggtgattcgtacaacgatttattttctcagatgaaggtgatttttaacaatatagatgagaaatatcctgataaaaagaaaggggtattcctggcaaacgacacatatgccaacatgtttttgaaccttgtcatacaaaaatacggctgcctgccggacagctatgagatagtcggcttcgacaattcaccaattgccaacgaagccataattccaatcaccaccatcggccagcagatagatgtaatcgcaagaaccgccatggatttactcgttaagcagatggataaccgcaaacaaagaaagcctgagccagatttggcgccaacgcacaaaaagatagcgcctgtgctgattcgcagggagacaaccagctagtacatcgtttatgtgacatgtaccagcctaattttctcctgttgcgtcctgatattccctgctgctcacacccccaagaggttttatccactgaaaacctcatttgtggttttactgtaccttctttctcatgcgcatctcccacacatagtaggtcacaataagtagtattcctgttgtaagccaggctgccggatctgcaaagcacacaccgccgtaaccaaatggctttgacagggcaagtattgcaatccatctcgacacaagctccatcgcaccgctaagcataggcacaagacccttgttaagtccctgcagaccgtttctgtatgcaaaaatccatgcaagaggaagcatgaagacactcgcgattttcagatatttcatagcacagtcaatgtcagttgccgtaggcgatgtgataaaccagcctatcatgtacggtccgacaaagcagttaattgctgccgctaaaactgcgcagcctatacatatgaaaaagcatgacttcatacccttaaatatcctgtcgtatcttcctgctccaagattttgtccgcagtaagtcgcagcggctgttccaagtgtaggcatggtctgtgtcgcgatattgttgaccttggatgcggcggtatacgcagctactacctgcgaaccgaacacattgaccgcagcctggaagatcatcgttccgatagcagtgattgaatagttgagtgccatctgcagaccgattgagagcatgcgccagattccgctccagtccatgtaataatcctcacggctggtgcgcagcaaatcatacttcttaaacatcacgataaatgacaaaactgcagcaattccctgcgagataactgtcgcataagctgctcctgccgtgcctgccttcaccaccacgataaagaatatatccagcacaatattcaatacagatgaaaaaatcaaaaagtacagcggcgtcttgctgtctccgatacttcgcaaaagaccggaagccacattgtaggacatggtgcagaaaattcccgcaaaaatgacctttatgtacgcatcagccatgacaagtatatcatcaggtgtattgagccagataagaagctgcctcgacgcaagcactgtcggaatcgtgagcaccactgaaacaatcacagtaagaatgatagctaaagccacataatgcttcaaaagcttctcttttttcgcaccaaacgcatggcttgccataactccaaagccctgtgctattccatttgcaaagccaagcaccagaaacataatacagcctgtcgagccaaccgccgcaagcgcctttgagcccagatactgccccacgataatcgtgtccaccatattatagaactgctgaaacagatttcccatcagaacaggaatcgagaacagcagtataattttcattggattgcctttggtcatatctgtcttcatgtgtaaataccctcccaaaaaattcaattcataataacttttcccagcaggttcacccctgcagaaaatccattaaaaaaatgtgtgaacaagctctttttcaaagcctcgttcacacattatatacacatattttccagtattcaagtactattttcaaaatttataacttattttttaacagtacgtttattctttcttcctcacacgataattcacatatctctttatcaggtagtacacgacaccccatgtcggtactccgatgaacagccccactactccaaataatccatttccaaggaagattgcaaataccacccagaaaggtgagagtcctgtggactcaccgagtatctttggtccgataatattgccgtccacctgctgtaagataatgataaacagcaaaaatatcacaccctttgacgggctgtcgagcatgatgagtatggtgcttggtatggctccgatgtacggtccaaagaacggtatgacattggtcactccgactatcacgctgatgagtgctacatacggcatgcgcagtatcaggcagcacacgaaacagatagctccgattatgagtgaatcaatgattttaccactgataaaaccaccgaatatcttgtcgctctcttttaagatgcttgaaagcacctgtatatggcgctccggcagaaatgcgctcacgagctttttagtctggcgtttgaaggtatccttgctaagaaggacatagatggcaacgatgaatgcaacaagacagtttaccgctgtgccaaagattcccataataccgtttatcacaaaggtaacctgtccgagcatattgtcctttacccattcagtaaaatagcttatgccgttattgtatagctcagtgattatttcctttgccctgtcattgtttttggcaagctccgtgatttttttcacaagatcctgtatctgatccggtaaaagactgaccgcatttgtgatattgcttacaagctgtggcaccaccatcatgatgagcactacaataatggctattattatggccagacttataagtattgacaaccctctcatagaaggtctctttccacacttcttttctatggctttgccaagcgaattgcttagctttctgtcataaaactctaccatcggatttatgagatacgccagcacaatccccatgatgattggcataagtatgtttattattctcactatctgtgccattattgcatcgaatttaaatagcacaaacactagcaggattgctcctgctagtgctaaaaactgtgaaaaccctttggcccatgcgacctttatggtgtgcttcatcttattattcacttccatgcgcgattcctcctcgtttattgtatgtccggaatgtaacaagctgatattatatagtctttaatcaattctagcaacactctcgccctctgtcagctcaaatggtattatctcatgacatgagcctttatgcaaatctatcatgttaaaaagaagctccacgctgcgtgccgccatatccttgtgcggctgtctgatagatacaatcttgggattgtagtactctgcaagtgtcgaaccatcaaagcctgtgatagatatatcttccggcaccctgagtcccttatcaagtattgcccttaaggcaccgattgccatgacatcggaaatcgcatagactgcggtgatttctatatccttttccaaaagctttttcatcgcacgatatgcgctgtcatatgagaatcgcgctctctcatagtaacgctcatcaggtgtgattccatgcttttttaagctgttgagatatccgttatgtcgcagacgagctgtctgtgaaagctccagattggctccaatctctgctatctttgtatgtccatgctcgatgagatagtcgacgattgtttcccctgccttctcatcatcaatggaaacagatgacagctcctccatgctccagttttctgccgatgtggtcacgataacacacggcaccttaaacgaagatgtatcctccgagaaatcctccctgctgcctccgaggaatatgatgccaagcggctttcgctccctgcatatgcggtctgtcacactgcttagattactgtcctcatccagatatgtgatgctcaaagagtagtctgttctgtctattatcgactggatttcctcgactacgtttgcaaacagcatattagaggtaccctttaccaacagataaatatttctggaaatggtctgcttgagcctctttgcattggtatttggcacaaagttgtgtgcctcaactattttcattatggtttcttttgctgcaggagaaacatcctgcctgttatttaaaactcgggatacagttgttactgagtatcccgattcttttgctatatctacaattgtcattgttttccccgtccggacagcgatacgtccttttacattatatccatgtgatataatttatttcactcgttatatcatatatccacaactacaaaacctgctaatttagcttaagccccacatgttttcttaacaagtgtggggcttaaataacataaactatatcctcttgtaagctatattaaccctttacagctcctgcgagcacaccctctataatgtacttctgacatacaatatagaagataacaattggcagaatcgcaagcacgagcatggccatcattgcaccccagtcaatcataccgtggctctgctttaagtactgaatagcaattggtatggttttgtactggttgatgtttaaaaccagtgatggaagaaggtaatcattccatacccacattgcctcaagtatcgctactgttaccgctgtaggacgaagtattggaaatacgaccctgaaatacatctgtaatggtgtacagccatcaatcatagctgcctcttcgatctctaatgagatactctttacaaatcctgtaaacataaacacagcaagtcctgcaccaaagccaaggtatacaatgatgataccgagtggatttgataaatgaagcatatttgcaaattttgataatgtaaacattaccatctggaatggtacaatcatagagaaaaggcaaagtgtatacataagctttgtgcccttagtctttacacgaactatgtaccatgcacacattgagcagcagagtacaataagtactactgagccgactgtgatgaaaagtgaatttccaaagcagtcccagaaatgtgtcattctgagaccattcttgtagtttaatgtgctacagaaaagccttgacataccatccttgaaggcttcaaagccctcagtgatagatactgtgctgattccaaacggatgcttgaatatgtaggcttttctcttaaatgaattgagtaacaccataaagattggtgaaatccaaagtactgataaaacagtgaataataatgtgattatccaaccgtgcttggcctgtcttacggcactgacttcctgcgcttttttctgttttgccattagtcctgtacctccttgcttgtagtaatcttattctgtgcaagtgcgataattgcaacaattataaagaatataacagcctttgcctgacctacgccctgccatcctgttgttccatacatggtgttgtagatatttaaggcaagcagctctgacatctttcccggattaccgcctgtaagagctaagttctggtcgaacagcttgaagccgtttgtcagtgtcaggaatgtacagattgtgattgtcggcataagcattggaagaataacgctctttaagagctgccatctgttggctccatcaatctttgctgcctcaataagctcacccggtatattctgaatacctgcgatgtagataatcatcatatatccaatctgctgccagcatactactgcgataagtccccagaatgctgaccactctgagcttacgattgtctttgaatagttctgcaggatagagttaaaaatcatcagccatacatatgaaagtacgattccaccgatcaggtttggaaggaagaatactgtacggaaaagatttgttcctctgattccttttgtaagcgccattgctattgcaaatgatacgatattgataatcagtaccgaaactactgtaaatagtgctgtgtaccagattgaatgaataaaggttgtatccacagtgccgtttacaacaaaaatccttgtgtaatttttaaatcccacccatttccagtctgtaactgtggagaatttacaaaatgaaaggaagataccatatacgaatggtacaataaatcctattgtaaatgctgccattgtcggtaaagcgaagatccaaaatttttttctaatcgacttttccataacaaatatacctttcttaaaaaaatatggggtgagtgactgccactcaccccacttttactactttttactaacttttagagaattttactgctcgttctgaagatcccagtaataagcccatttctctgagaatgcctttgcaacgtcatcccatgaaccattacgctccgtgtactctgtgagtggagcgaggaaatcagctctccagtcatctactgaaggtgttgcgttgaatgaccatgctactgatgtcttgccttcctttgcaagctctgatgctacattagcaaaagcgttctttgactcatagtcacctgtgaatgtatcgaatggagctgaaagacccattttattaacgattgcgtcacgtccgtcatcacttgtgattacccagttgaggaattcaagtgttgcatcaatatccttctgatctgccttagcgtttactgtccagtggttctctgtaccaactgcaagtccctcgttctcgtcatctacaccgaagtagataggcatcattgaaaggtctgactgcttaactgtgtatccgttctcgttgtcatctgcgaagttagcgtactcccagtcaccattctggtagaatacagcctcttccataccaagctctgactcagcatttaagcttcctgaatcaagtgtagccttgtctgctgctgatgtatttgtgtacatatcccaaactctcttgaagttgtccatgtacttacctgtaacttccttctgtcctgctgtgaggtcacatcctgcatccttgaactcatagtagagtgcgagacctgcgagatgtcctgtgaatctccagttagatccgctgtcaagtcctgctgaagcaaatgcctctgtaagatgtaagtcacaagctttgttgatatcatctacatgctcgttgatatcagttgcaaccttctctaatgtatcaagatccttgatatcatctactgacttgataactgctcctgagtagttgctgcagtatttctcaagaattgccttgttgtagatgattccgtagcactcatagcagttagctactgatgcaatcttgccattatactcaagtgcaagtgacttatctgtaaggtgcttgtaaatctcgctgtcctttaagtcatatatgtatttgtcatactctgcgcagtctgctgtgcttccgatattgaagattgttggagcatccttcttagcaagctcagacttaagtgttgtcttgtactgtccatcagctgctgttactactgtaacctgtacgcctgtctcatctgtgtacttctctgcaagatcctgccatgcctgatctgtctccggcttgaagtttaacatgtaaactgagccatcgccgccctttgcagatgagcctttctctgttccgtctccgcttcctgatccacatccggcaagcattgttgctaccattgaagaagcgagtaatactgttactaatttctttttcattttaaaccctcctaaaagatttaatattaaaattgtctttgcaaacatccctggttgttttcggtaatgtttgcggtaacgttttcacaagaattattatagtacagcttcgtgtagtttcgcaagaggattttgtcttttctgtatatattaataaaaacaccaggtattttttggcaatttttcacaaaaaattgcaaaaaaataagtattctcacactggcgtttggtcattttagttattttcgactatccgttttgtgtaaaaatacttttgttatttttattcatttcatctatcagagcctgcttttgtgcgcgcttgagctgttttatatgatactccctgctcattgcctcctctttcgtggcaaagtgctcgaaatagaccagctccacaggtctgcgtgtctttgtatatttggcacctttcccggagttatgcgcttttatgcgctttttcaggtcatttgtccaaccggtgtaaagtgtgccgtcagcacaccttacaatatatgtataattttcatccatatctgctttgtccatctcaataatcaacgctgtgcttatgacatgacaatatgatatcatgcctgcccctgaatcgtagtgccatagcctgacataagcttaaactctgctctgtcgaccactctgcagctgccacggttgtctgtctttacgctgtatagtatctcatctgccacatgtaaaaaatcccacactctgttttcttcctttggtacatcgcaatacatgccctgtgtgattgtgacaataggcagcatctttgaaaaccggtgtggcagagtcagctccataaccttgcggcgaagctcctccacatattctttagcatcttcctttgatatattctcgtacatgactacaaactcgtccccgccatatctggcacaaaaacctccatgtgctcccgcaacttcgcttatacaacccgcaatcgcaatcagacatctgtcaccctcctgatgcccgtaattatcattgtactccttgaaataatccacatccagtatctcaatagcaaaattgtgaccacatttatgagcatgcgaaaacatctcatccgcctgtatattaagctttcgcctgtttgccatgcctgtaagcggatctgtctcagactgcgccgcaagaagcttattctccttctcaatttttttcttggcacgatttaccttctcgaaattcgccctaagctctatgacctcttttatcatagccttggcctcaagctccttgcgctcggaaagctcatagtacagccctgccgcctgcagatactctgcacccatatggtgctttctgtaaaatctgattttaagacctaaaaatctcatctgcatgcttgtgaccttaagattgtttatcatcggctccataagctccatcagatgccagaattcatcaatcttttcactctcgaaaagcacctcgagatacacaaagaaatcctctatcagatccataaaaagcatatcctgcgtgattacaccatcaatgcgcctgatacactcgtcacgtttttcaatctgtccgcttttatgcatgtaaaaggttctgctgataagcattccaagcctgtcgattgcatctgcatacggcagatgctccctctccacaatctcaagaatctcatctattccggtaaagtcactctccagtaccttgcagtttatcatattctcataaagagatatcatcctggtgtgatatgaaggttcatccggtgcggaagctatgtattccatggctttttgaaaataatccatggcctccttatacctgcccactttgatatttaaagctccgcaattgacatttataatgccctgttcttccaacaggccatacttcttgcagtacgtcagtccatccagataatagtcatatgctaccggctgattgcctccgcttgacatgatgataccaagtatattgcatgcgcgcgccagcatgctccagctctgcgccttctccagatgatctatcgccctgaccacgatatcaaaaatgttatcgtagtcattcaggcaataaagtgtcatggcaagatgatagtatccgaagcccaagagttttgaatctgctgtcttttctccgtaatctatcagctcatggcaatatctgattgtgagctcggcgtcctttctgtaattgtcaagaatgccatttgtccagtttttcacactctcattgtattcgttaaactccacttttcacctctatatatctccgaaatagtccataggattgaccggttttccatcctgttccatagcaaaatacacattggttccctcaacagtatagtatctggtcacctttccaactgctccaagtgtttctcctgcctcaagcacatcgccttcactgcaggttagatttgcaagctgtccgtaagtagccgtatagccgtctcctaaatcctgcactactgtacagcctgtctctgcgctgtcatatatgtctataatcctgccctcggtaactgagcataccgcatctccttcgtttgcacgtattaccatgccacgattatactgatactggtcgagtgtcgggaaataaaccgtcttgtccatggaaaacggcaaaagcacatctccctttacaggccagtttgtcacattttcagggacaaaatgcagttgtttttccgtgggctgctgattttcctgctgccctgcagctgattcttcctgtcccatttttgtctctgagtctactttttctgtagttttctgtggtgtctttttctctgtaggctcaactatagacgaagtctgtgaaatttctgttggtatctcgtctttcccgggtttctgtgttgaatataccgctgcaaatcctatggctccagccacgagacatgccgctgctgcaatttgttgttttttcataggacattacctccatcatctgaattgttctgatgatagtatgtcctgtctgcatggatttattcatgctttttctattttgcggcaccaattatatttgataattgcgcaaactgtgcaaggcttagagcctcaccacgcacatttacaggaactccgagagtctctatgctctgctgtatctgctccttggtcagtcccataccaccgaaattgttgagcccattggcaagagttttcctgcgctggttgaaagatgccctgatgattttgaacatcagcttttcatcatctacgtcaaccaccggcttttcgtatcgcttgagcgatataacagagcttcctacctttggctgtggcatgaaacagcttggcggcacatttaccactatctcagggtgcgaataatactgcaccgcaagtgacagagctccgtaatccttcttgccgggacctgcctgcatacggtctgcgacctccttctgcaccataatggtaatgctgtctatcggcacatgactctcgaacagccccataataataggtgtcgttatgtaatatggcaggtttgcaacaacctttatcggcttaccattattatattcttctgccagagcatttatgtctacctttaatatatcatcatttatgacctttacattatcatattcactcagagtatccttaagtataggtatcagatttgtatctatctcgactgctattacctggcgcgccgactcacacagatactgtgtcatcgtacctattcccgggcctatctcaagtatcatatcgtcctttgtgatgccggccgagtctatgatttcctccaaaatgcctgtatcaataaggaagttctgtccgaatttcttttgaaaattgaaattgtatttctgcaaaacctcgattgtgttcttaggatttcccaaatatgccatgatatgcactccttgtgtcgtttcatctgatgcgacagtacaactgctgtcattatcttttataatatcacatgaaatgcctttatttcaattatattcgtgaattttcgcggttttgtcggaagcccgggacgaaagcatgaaccgccgccctgccatggggcacggtacactcccgcgtgagctacgcttcgcagttaagattctgtacggattatgtctaaggattttctatgcttgacgaaaccggcttttatgcaccgtccatggtgcataacgccttgcccagccgtccatggctgggcatttctgcgtatttaagcataatcctacagtatctaaaccgcttcgctattcgctcacgcgggagtgtaccgtgccccatggcagggcggcggttcccgactttcgtccctcacgttgtggctcaatcacttacacgtgtgaacagttcaaatgcattggcacgagttttgcgctctacctcatccggtgtagtgcctttgatttctgctatcttctttatcacatatggaatgtttgacgaatcattcctcgtgcctcgatgtggctccggggccatgtatggacaatctgtctcaagaaggattctatcaagtggaagctctgacactgtctgtaccagcttctttgcattcttgaaagtcacgacacctcccactccgatataataccccagctttacatactccagtgccatctccggtgaatatgaatagcagtgtatcacgccgcggatattcttttttgctgcctctgtcatgatttccatggtgtcctgtgctgcatcacgcgagtgtatgataaccggcagcgatgcttctgctgcaagctcaagctgacgcttaaaccagtagcgctggttttcctgcacctttggctccttatcccagtaatagtccagtccgatttccccgactgcaacagtcctttcccatgcggtctgttccctaagccatgcaaaggtttcctcgtttaaatcagctatgtcgcttggatgcactccaaccgctgcatatataaagtcatatttctttgcaagctctattgtagtcatggtagagccaatagaagccccgacatttattatcggggcaactcctttttcatggacgcgttttattgtttcatcacggtcgtccttaaatctgtcatcatcataatgggcatgtgtttcaaatatcattaattactgtgtccttcctccgcccaaagcttatcggcacaaggcttccatgcctgcgcatactccttacacttgttgcacaggtgctccgcactctcaggtgactgcaaatcagttgattttgcacctgtttcctttacgagccgctgtaaaatctcaggattttcaagcataggacatggtctgtagtgattctcattaaatggttggttatcatgatatgccatgaaaagcggctgtttcaaaatctcaagcatgctgtgtgtacggatgttggctcctgagtagtgtatgaatacacatggctcagcatcgccgttggcattgatatggaaatagtttcttcctcctgcgatacagcctccgacaaactcgccgtcgttctggaaatccatcgtgaaaattcccttgccgcttgtcatatttctgatttcacggacacggtccttgatgtaaagtctctgcttcggattcggtaaaagctccagtgatgcatcgtttccgacaggcatatagtggaagtaaagcgcatagcggcagcccttttccacaatcatgtcgataaactcatcactggtaactgtctcatagttctttgaagtgtaacatattgatgtaccgaaaacaagtccgttttccttaagcaaatccatcgcatgcataacctttgcaaatacacctgtgcctcgtcttaagtcgtttacctctgagaagccctcaagacttattgcaaggtacagatttccgatacgctttaagtctgcgcagaaggcctcatccacgagtgtgccgtttgtgaatgccagaaatgcacagtcgttgtgcttctcacagagcttaacaaggtctgcttttctgacaagaggctctcctcctgtgaacatatacagatatactccaagctccttgccctgtgttacaaccttatccatctcatcaaaggtaaggttcagcttgtggccatactctgctgcccagcagccggtgcagtgcagattgcaggcacttgtcggatccataaggatgagccatggcacattgcagccatacttttcacgatttttacggatagtcttggtaccgtaaacaaatgcctcaaagcccagattgagtgcgattgtctttaacacatgaggatctatttcattgataagacggtgcatgtacttgttgagcgtgcagtccttatcgcagatcatcttgcgcgcactgtcatagtttaaatcaatcttctcatcgcccatgaatttctgccacatgtcgataagctttacaacctctgtctccgggtccttgcaaagtccttttacaatgttgtcacatatttttgatgcagcaagtctcgctgcctgatgtcctaaatttcccactttgtattcctccttattgtttcaacggtatttctgacgacaaataaatttagtattccgtcaagactcaaattcagtcctattagtctaactatcatgcctgcggtctcaaatggtgtcacaagaagcagtattcccacaaatgccactacaaacgacatcacgagtatgagccaccatctctcgatgccaaaacgctttgcttccactgcggtctgtatctttaaggctgcgtccaccagcataaaaatgcctatcgctgtggacaatatctctataatatactcagtttttttaataattatgattccaagcactattgaaactatcccaagcgccaggtcaaactgaaacgcaagctgaaataaatcctttgcaaaatatccggacaactttgtcactccgtatactatgagaaacactccatacaccacgcacaaagtcctaagtccaagctgtggcgcaaataacaaagctgcccccaatgcaatcaggcatattgtcatgacagtgtatgcatttttcacacgtaccaatgtgtgcataaagtatctccctcctttttgtctgctattctaatccaccataatcgtctttaaaatggacaaaaaaataagagtgtctgaaattcagacactctgtcaaatctgttcgaattattttgtcatacaatatccgcctgcctacagacagcactcaatcatatcataaattgtggcatcgaaagagtcacctattctcttaacaatatctctgttgtattggctttttgacagtccaacgccatttgccgtaatgttctcaggcaaacggctcatcatactgcctctctcaatccacttaattgtactgcccacgattccgttgctgtaaaacgccgtgataaaagcaatgtcactatcatccaggctgtagccctctgccttttccaacacaaagcggcgcaccacctgcgtaaccacggcatccagatatgtccttaataccctgccgttttccgatgcataaatgtgcattatcgcctcgcggttattaagaataagggcagcgactctggcatatgcatcatgaaatgtcacgccttcctttgcctcatccatcacaagcctgacctcgtcctcaaatatggcctcaagcacatcatatatgtccttgaaataatagtaaaatgtatttctgtttatctcacactgctcgcatatatccttgactgtaatcctgtcaagcggtttgtttttcagtatatgtaaaaaagtctgcattatggcttttctggtaaatgttgccatgtgtatatctcctgatgtgcgtattatacataaaccctactctcaaccgccattatattacgattgttatatttttgtcaaactatgtcttcgtgtaacttcaaagtaaattcaaaggccaacaccaaaagaaagaaacttgtctattaaaatccaaagtccgcataatcctgcggcagaaatctatggtaaataatatggcagccctcatcatggaagcaatagtagtatgtgtcatccggctcatttaagaagcggatgtaacagtcaaactcgccgttttgcatttcctttttttcgatgtcgtccgagtatttgtaaaacaactcagttatctgctccatggtgcagccatgcgtgccgacaagtgtaatcagctcccttataaactcgttgtcagctgtgttttcatgcacatactcactgccctcaggtggtatctctatgcagaaacgctcattttttgcggtgacctttatctcacctatggtgtcagtaagctgttttggcaggttgtccggtgcaagtatttcaagcatctgctgctctgaaattacgccggctgcaattttattgtcatcccctgcacactcaaagaaatgtctgagcgtggaaagaggataatacagtctgactatttccttcctgtagccaagcttcgcctgctgctcttttactatatcaataagactcttcgccagacgagcgtaaccggtggcgctataatcgctgctgtaattgtctctataatcgccgctgtaattgcctttataatcgccactataattcactttgtcgtcaaaatcgcttgttttcgtcataccgatagcttctcttcctcccggcttttaaggtttttctagggcatgctcaccttatcgagtattcctgtcaggtgtgctatagccacgccatagtttgtcatcggcacatgctgagtgcgtgccctgtctattcttgataatacatattttctgttaaacatgcaagcaccgcactgaataacgagatcgtactgagaaagattatcagggaagtctgtaccgcttgtaatatccacggtaagctcctcaccgacacgctttcgaagcaggttcggaagcttcaccctgcctatatcctctgcaagaggcgcatgtgtacagcactctgcgataagcactcttgaggatggctttaaggcatcaattgcccttgcgctctccacataatatggcagatcacccttgtatgctgcaaaaagcactgaaaatgatgtgagcatactctccgccggtttgtgctcgtacacatagccaaacacctgtgaatctgtcacgatgagctttggcgcgtgagataatgctgcaagcgcatctgtcattttgtcagtcgtcgtgctcatcacaagacattttctatcgagcaattccctgagtgtctgcacctgtggcaatatgagtctgccctttggcgcctggatatcctgcggcataacaagaagcaccaggtctgtctgagaaacaaggtctcccaggataaattcctgtccgaaatcctcaggcaaaaggcgtgtgagtgcagagataacggcatccattcccttgccctttaatgcgctgactgctacaacctcaaagctattgtctgcatttttgcccatcacagcactgttttcctcataaacccagcactttgcggcctctattgcagcattgtcaagctttcccctgctcttttcctgtacctctgcggaaagcaaaatctcgtctatcttgtttaaggcaaatacgaccggagtatgtttttttgcaaatagcaggctccactctgcctcatccttaaaagcctttttaaatggtatccctgccttctttgcagcaattacctctgcaatatcaagcactacaacagctatatctgtcttctctgctgccagatgagtcttttccacacgtctttcaccaagctcactgtcatcatcaaagcccgccgtatcaataatcacgcacggtccgagcggatgtatctccatcggcttgtacacagggtcggttgtcgtacctgccacgtcagctacaatggaaacctcctgctttgtaaccgcatttatcagagatgacttaccactgtttgtctttccgtatatacctatatgaagtctgttggcagaaggcgtctcattcaaatttcccatatttcctcctttagaaacggaaatcacgctttccgtctgcaatatcatgtatatgctcatagcatgtctgcttaacctttggattggtaatcttttctatttctctgtcgatgagcttcattccaagctcccttgtctgcgggcttgcatagtcctcgagatactccttaagtgtcatgagtgcgttcggatgacagcaattaagtatctgcatgctcttgcacagtgccataaaacggtctcccgttctgccttctctgtagcaggctgtacagaaggacggaatatagtccatcttcataagccagtttaccacctcgtcaagtgttctctggtcgctgacatcaaactgctccgatgttgcctctgcatttttctcagcctccgggtctgcatagcctccaacacttgtctttgatgcgccgctgatctgtgaaacaccgagcggcagaaccttttcacggacagtctggctctcacgggttgagattatcattcctgtgtatggcactgaaatacggataagtgcgcatattttggcgaaggtatcatcactgatgccattgtcaaatacatccgggtctatatcatctgcgtgctttatacgcggcacactgatggtgtgaggacctacaccgtgcactgcctcaaggtgctctgcatgcatcaaaagtcctgcaaactcgtacttgtatttgtccagtccgaaaagtacaccaagtcccacatcgtcaatgccgccctccatagcacggtccattgcctctgtgtgatatgcatagtcatgttttggtcctgtcggatgaagctgctcatagctctccttgtgatatgtctcctggaagagtatgtaggttccgattcctgcctccttgagctttctgtaattctccactgtagtggcagcgatatttacatttacacggcggatagctccgtttttgtgcttgatgctgtagattgtgttgatacactcgagaatatactcaatcggattgtttacagggtcctctcctgcctcgattgcaagacgcttgtgtcccatatcctgaagggctgtgacctcctttactatctcctcctgagtgagcttctttctcgcaatatgcttatttttcatgtgatatggacagtaaacacagccgttcacacagtagtttgacagataaagcggtgcaaaaagcacgattctgtttccgtagaaatccttctttatctgctgtgcaagcttgtaaacctcgtcaagcttctccggaatctcacaggctaaaagcactgatgcctctctgtgtgtgagtcctttttttagctttgctttctcgataatcgcatcgataagccctatattatttttgtttgcctctgcgtattcgagagtctctttgatttcctcgtctgagatgaattcctcagcctttaatgattttacgttgtacatttttatctccttctatatcctagtgctgttttatatttattaatcgtaactattaatcaaaaatctgcgtagtccccgcgcgacaccaccacctgatagccgattcttttcatccggttttccatgcagaagcggcactctgcagcctcatctccggtgcagattttattgtcgtaaagcttgtatttgtcacggacattgaccggtgagaggtttggcatcacgacattggcacccgactgtatacccttttccctgccgagcggatggattgtgccaagcgctgtcgtggcaggcagcagcacttttggatgtatgagcctgatgattgaaagcaggcgaagcgtctcatccatcgtacctgacttctcgtttgcaaaaggtgtatccttctgcgatatgaacggaccgattccaaccatgtgaggctcaagctcctttataaactgcaaatcctcgtacaaggtctccactgtctgtcccggcgagccgaccatgaagccgcagcccacctgatatcctatctctttcaaatcccaaaggcactgctttctgtttgcaagtgacatctctgccggatgaagcctactgtaatgcttttcatccgcagtctcatggcgcagcagatatctgtctgcccctgcatcaaaatagctctgataactctcctttgacttttctccgatagagagtgtaactgcgcagtccggatactttgccttaatcccggacactatctcacagatgcgctcatccgtgtaatacggatcttcacctccctgcagcacaaaggtacgaaaaccaagctcatagccgctctcgcagcatgccataatctgctccgtactcaggcggtagcggtccgcatgggtattgctgtgccttataccgcagtagagacagtcgtttttgcagtagttggtaaactctatcagccctcgtataaaaacctgattgccataggtctcgtgtgctttctcagatgccctctttctaaggtaatcaactgcctgcatatcatccgtctcaagcagcatatgcagctgctcgagggtgatattccggcaggccgtaatttcatctataatttttattattgctgtattttcggtcatgctttctcctgtagtctgctctgctttatttattagagtaaactgtcttcactcctatgccatccagcctgccaatcctgccggacaaagcactgataatatcctgtggtgcgtcaatcgccacactgatgatattcacgttctttttctcgtatgggatacccatgcgcccaacaataaagctgccgtactcatgcagcagatgattaagctgctcaaccgaatccgggttttcaactataatgccgatcagggctattcttgtttccatgcgttactccttataatatttaatatgcggttattgtacctctttgtatttaatgagaacaaagccccaacattaattgaaaattcgcctctttcgaggcttctccgcagcttgacgctgctacaattttcaatttatgttgggatgtccaataaccacatacgcccttgcatgcgagcatgcagatgcgcatgcggttattgtacctctttgttcactaacaaagggtgcacttcgccggaagtacaccctaaatcttaaaatgttcttcctccttatacgtgaagcaactatcatctgctcacagtatttggtgtcagtgactctgaattatgacatcagagccttcaatgtctgcaggcttgaagaaagagagctgttatcagcatgtctcgcttcttgcgtgctatctaatatctaatccgattgtatcatgtctaaatcatttcaacaatattatatctgcttgtttcccgaaatatacactatttttggacaaaaaaagaacagccatcgttctgctgtcctttaggagaaggtattttactatggggatagtaaaaatatataatgtattggggggtttttacgttaattatagtatcacgtgccatgaaaaatgtctattatcgtgatgcacaaacttgcataaattttcaattattttttatgcaatatgtatatgattgatttaagataatcatttggttacaattacggcccattaagaatttcaatatttttgaaaagaaatctacttacaagttgacttttttaacctaaaggaagaaaatagaaacataaattggaaggaaaggagcggactctcatgaagaaaatactggttttaccactgttgctttgtcttatattctgttcctttctaagtctcgacaaaaatctggacgaatttgatcctgaccgcacagcatacggttcatacgatcacagggttgtctggggctcttatgcctcttctgataaggccgcgcttccacagcaggaagtcttggactcacgcgcagtgctttattcagagtcagatatgtcggctctcatggattgccagtatatagaagaaataccttcttttcctgaagtcatatgccgcatccgtacctcttcgcttggttttttaggcaggcttacatccaatttaagctggcttggtgcgttactccagttaatacatattattttattcgcatatgccgctatcgtggtcatgcgcatatgcctcacaaacacgagccggcgctttattatccgttttatccacgacaaggatgggcataaactaatttccttcgctgattatttcaaaattcgcgcatatgcggaggaaatataacttagacacattaaataaacattttctccgcgtcatgctgacaaagtaaaacggaggatttaaaatgcttgaagcaataataattgtcgtgtgtgctgccgtttgtatcggcgctgcagcctatgcctggtggatggagaacggtcctgagaaggacgacagtgatgcagccggaaagaacagccaaggccatgcttataccaaatacgacagcaatatcaaggatgatattgtctttcacaaagcacacaaataatgataacatttatcaacattagtaactataaacctaaataaattatctcacccaattcgtcatgcatcatctttaacccggatgatttatggcagaacaaaacgagccgcaatcctgttggtatcaggattgcggctcgtttttatatttctgtatcttcacctctgcaaaacgatgtgctaaatattaagcatatcgctgagctccttaagtgctccgtctgtctcatgtgcgagaaccttctttgcaagaatctttccaagctgaacaccttcctggtcgaagctgtttacattccataagaagccctggaacatgatcttgttctcaaagtgtgcaaggagtgcaccaagagatgcaggatttacctggtctccgatgataatgcttgaaggacgtccaccctcgaagttcttgttcttgttgtcgtctgccttaccacatgcaaatgcaacaatctgagctgctacgtttgcgcagagcttctgctggcttgtgctgtcctggatgactacatctgtgtcaagctggttgttcttgaagccgatgaactggagtggcacaatatctgttccctgatgaaggagctgatagaatgagtgctgtccgtttgttccaggctcaccaaagataaccggtcctgtcacataatctacaggctcaccgaaacggttaaccgacttgccgtttgactccatatcagcctgctgtaaatgtgcagggaaacggctgagtgcctgtgagtatggaagcactgctgtgctaggatatccgagtacgtttctctcgtaaacaccgatgagtgcgtcgagcatctcagggttttccatgatgtctgcattctttgaaagcttatcctctgctgctgctccgtcgaggaactgtgcaaatacttcaggaccgaatgcaagtgagagaactgctccacctactgctgatgttgatgagtaacgtcctccgatgtaatcgtccatgaagaaggctgcaaggtaatcatcgctctttgcaagtggtgatgtctcgcttgttacagcaatcatgtgcttagaagcatcaagtcctgcgttctttaatgcatccttaacgaatgactcattggtaagagtttcaagtgttgtacctgattttgatactaatataaaaatagagtgagctacatcaactgatgcaagtacgcttgccgcatcatcagggtcaacattgctgatgaatttggcttccatcttgaatgtattgtttttctttgcccagttctcaagtgctaagtacatagcacgaggtcctaaatcgcttccgccgattccaatctgaacaactgttgtaaacttctctcctgctgcgtttgtaatctcgcctgagtgaaccttgtttgcgaactcagcgattctctcctgctgctctacatagaatttacgcttgtcaactccgtctgccactacagcatctccgagctgtccacgggtaagctggtgaagaacgagacggttctcacctgtattgataacagcaccattgtaaagtgcctcaaatttctctgtaagctgtgcctcctttgcaagctttgcaagtgcctcaagcacatctgcgtccacctgctttgcagcgaagttgtaagtgaatccctctgccattgggatgttgtactccttgacacgcttagcgccattgtctcctgacatggcctcttttacatcaacacgtcccactttagaaagctccttgaaggattccagtgtatccaagttgttccaggtaatcattgcgatttcctccttatcatttaatcttatttttcaccaatcgcttaaattatactatcaatcatttttaagttcaagggctgagaaactttataagtaagtttttagataaaatttgtattttgttttgtttgtgtgcgaatatgcactttttatgtgaaatcagtaaatattcagttccatactcatcctgcgcatgaatgcccatcttcctatcggaggcattcacatatttctttgttcttttttatttcgtcgtatgtcaaaataatttattctgtttcctttcttactgtgtaactatatgcgtctaagctcagccagacagatgcacacaaatccaagcattcctgtgataccgcctgccgtgaaagcgatattgagcactgcctttacagccatcactccacacaacttagcaagtgcaaatgccaccgcaaaaccaaacacaaacgatactgctgtgccaagaagtaatattatgtatctgtattttgttatcatttcttcgtcaaacatattttcctccatcaaatcggctatcagaatttttcatcactattcagacccccacgcacattcgcaaaaccgcacgatactcgtgctttgtctacactccgttccggtccgcgctgaacaaacgtccaccggacgtttagcgccgctgctacgcagctaattttgctcatatgtgtgggggtggctctattcgagccaccttgagaacaaaaaaactgccgcttacatgcaagcatgacgcatcagcttttttgttctcagtggttctgaatagttacttttaataatatatcattctaatgaaaatatactgtctgcgttatgtaaaatttgttggaaattgttgtaatgcagttactacatatcagtaacgtaatgcggttttattaaaaatcagttgactttgccggttcaaggtactatactcatgtttgtaaaattattggtatctcccttttaattttacatatttacatagtttaataacggatttttgagagtgaacagagttcatgaaggggtacaccaccgcgggtgtattgctttgtgaactcttttttagtatattgcttcggggtaatccccgctttttccacatctcaatccggaaaggagacgcacaatggtaaaaatcaacggtaaagaagctgcagatgtatgcggcatgactgtttcgcagtatctttcagctaacaactacaaccctaagcacatcgttgtggagctgaatgaagagattcttccaaagactgagtatgacagcactgctatcgccgacggcgatgtggtagagattttaagctttatgggtgggggctgattaaaatcgaacactttttacaccatcaataaaaacataaggagttaatcatgagtaaaaatatagatttagcaaaagacaaattagttttaggaggtcacgagtttacctcacgtttcattctcggttctggaaagttttcactcaacctggtaaaggcctgcgttgaaaaggctgatgcacagattatcacactggcgctgcgccgtgcaaacgatggaggactggcaaacatcctcgactatattccggacaatgtcacactgcttccaaacacatcaggcgccagaaatgccgatgaggctgtaagaatcgcacgtttatcccgcgagctgggctgtggagacttcgtaaaaattgaaatcatgcgcgacagcaaatatctgcttccggacaactttgagacaataaaggctacagagattctcgccaaggagggctttgtcgtaatgccttacatgtatcctgacctcaacgtggcaagagaccttgcaaacgccggcgctgcctgcatcatgcctctcggtgcaccaatcggctcaaacaaaggcatctgcacaaaggaatttatccagattctgattgacgaaatcgacctgcctatcatcgtggatgcaggcataggccgtccttcacaggcatgcgaggctatggaaatgggtgctgccgcagtcatggcaaacaccgctgttgcaacagccggtgatgttgagataatggcagaggcatttaaaaaagctatcgaggccggaagaatggcatatctgtcaggactcggacgcactctgaccaaaggagccagcgcatcatctcctctgacaggatatctgcgcgactaatcataaatgaagcgcaaaataccttttgacactcatatcattatatataaagcacaaatatgataatcagcttttgaagggaacacataatgactaacgatacaaatataacaaatgacaaagatatcaatgcaaatatctcccacgatgaccacttcaacgacagcattgtaaacgaagtaatcctcgaggacatgaagaaaaacagaatagaccatatgaaatacctgcctgatatggaggtgcttgactccgatatcatggacagggttgttgccgaaatggatgcctacgactacgaccaatacaccgcagccgatgtacgcgcggcgctctcccacgaataccgcacattggaggatttcaaggctctgctctcgcctgctgcacagccatttattgaggaaatcgcacaggctgcacagcttgagaccagaaagcacttcggcaacagcgtatgcatgtttacaccgctttacatatcaaactactgcgaaaactactgtatctactgtggtttcaactgtcacaataaaatcaaccgcgcaaagctgaatgcctcagaaatagagaaggaaatggctgcaatcgccaaaaccggtcttcaggagatcctgattctcaccggtgagagcaagaaaatgtcagatgtcgaatacattggagaagcatgcaaaattgcccgcaaatatttcaaggttataggtcttgaggtttatcctatgaactctgacgagtacgcatacctgcacgagtgcggtgctgactatgtgaccgttttccaggagacctacaactctgacaaatacgagactcttcaccttgccggacacaagagaattttcccttatcgtgtaaatgcacaggagcgtgctcttaagggtggtatgagaggtgtcggctttgctgcacttttaggtctcgatgatttcagaaaggatgcgcttgccaccggatatcacgcatacctgctccagaaaaaatatccaagagctgagattgcattctcatgccctcgtctatgccctatcataaacaatgaccgtatcaatccaaaggatgtccacgaaacacagctccttcaggtagtatgcgcttacaggctcttcatgccgtttgcaagcatcaccatatctactagagaggtagcgcgtgtgcgtgacaatctcgtaaatatcgccgccaccaagatttcagccggtgtcagcaccggaatcggaagccatgtggacgatatagaggacaagggcgatgaccagtttgaaatctctgatggcagaagcgtggatgaggtatttaatgcactgctcgacaatggtttgcagccggtgatgagcgattatatttacgtgtaggaatcctgtaaacaatgaaatgcttgaattagaatcagtaatcattttaattttaacaggtataaatatgtatatatgaatatgtaggaacaaatatgaataaagaaaaactcttatacgaaaactcaaaacatgctttacagagtgataatataatcgctatcacaaacagacacctttgcagccgtccgttcatggaacagctcgagcgtgtctgtaagctccatccacatgcaattgtgctcagagaaaaagatatgccggaggcagaatatctgtctctggcacgcgatgtgattgctctgtgtaaaaaatatgatgtgcagtgcatgctgcacagctttataaatgtagcaatggagcttgagcatccgtatatacatcttccattgccaatcctcgaagcttatgtccaaaaaaatgtgtccggcaatatatccacaggtatgtcaaaaagcactgacaattatcaacaattcttcaaggttatcggaacctctgtccactctgtagaagatgccataaaagccgaacagcttggagccacatatatgacggcaggacatatttttgcaaccgactgcaaaaaaggactgcctccgcgcggacttgatttcctcaaaaatgtctgtgatgcggttgggataccggtttatgcaatcggcggcattaatattgcttcaagcggtgacagcactgcttccgatgcaccatccacttatgatgctgtgcgggacattagtgttccgcgacttgctgatgttatggaatgtggtgccgccggaggatgtattatgtcagggatgatgagggtatgatttaccgactatatcacagtttttatttttcctccaaaatatcctgcggttcacagcacaatgcctttgacagcctgacaacatactcgacctgtgctttatttatatcctttctgcgctgttcatactgttgaatagtttttacaggaatgcctgtttcttccgcaagaatgctctgactgataccagcccttttgcgtagttttttaagatatgtctccgctcttgatacctgactcatctctctcaatttcaaaatggcagatgaaatatccatctcatgataaggattatacatatttctgattttacaaataggtatctctttatcaatcatttcaaaggttttgccattctcccattggtaatatgccagaatccatcctgtccaatattcctggcttttagctgtattgtacgaaggcatgattatatcatcatcaggtatatctaatacccttatcgcaagttcagcgcccgacatcccggttatcacaaataaatcgccttttgaaaagcgcatactatattcagactgtaaaaatcttttataataatcctccagctcatatccgaggtcatacactgcataactaagcatctccccaagacttcgctgtgcaattcgaagataaaccttgtcatatgcgtaaatcatcttttttcatctcctcatctataatccttgaaatataaaatgtcctcctggtagaagtatagttatacaatactcccacaggaggacattttcaattcatatttacatttcgcacaccctagtttccgcactcaatactgatctcattgaatgttccaagaatatcatcaacctgcatagccttcttatcggcgccggccttgtcgattatcgccttgccctgatgcatcataataaggcggtctccgtattcaacagcgtagcgcagattgtgtgtgaccatgattgttgtgaccttcttctctgccacaatcttgcctgtgagctgcattacaatctcagcagtctttggatcgagggctgctgtgtgctcgtcaaggatgagaaactcgattggattcatcgtagccatgagaagcgcaagtgtctgcctctgaccgccagaaagtgccccaacctttgtgtgaagcttatcctcaagtccgaggtttaactccgcaagcatctccttataatgctctatcctgctgtggtttgtaccacggcccagaccgtatgtctttcctttattgtcagctatggacaggttttcaaggattgtcatggaaggacaggttccctttgacggatcctgaaatacacggcctatgcggcggtgtctgataaaatccttctgctttgtgatgtcagtgccgtttaccactatgctaccaccgtcaatagggatagaaccgcagatgatgttgagcatagatgtctttccggagccattacttcctacaacggaaacaaactgtccatcatctattttcagattaaaatcatcaaagaggcatatctcgttgactgttcccggattatataatttgtggatatggttgagctctaacattatgccaccttctttcttttgtttctatccattccaagcaccagaatgatgaggaacaataccgctgtaatgagcttcaaatcgctcgacggcataccaagctttatagcgattgccacacaggccttgtatacaatcgctccgataacaacactcgaggtcacacgtaaaaatgttgcctttttaagcaggctgattccgataataacgctcgccagtccgataaccattgttccggttcccattgatatgtcgaaatatctctgctgctgtgcaaaaatgcatccgcttaagctgcaaaggccgttggcgattgcaaggccgatgatttttgtgatgcccttgtccacacccatagatgtaacgatagtctcgttgtcacctacggcgcgaagcagatatcctgactttgtgctcatgtaccagtcgagcaggaatttcatcacaagtgtgataacaaggatgataatcacatttgaaaactgtgctaagccgcccttaaatacatttctgacaaaatcattgtcaaaaagtgtggtcatattgtatattggcaggtttgctcttcctgcaatacgaagattcaccgtgtaaagcgctgtcatcatgataattcccgataaaaggtcacgcaccttgagcttcacatggatgattccggtcagcattccggcaaacgcacctgccgcaaaggtcacaagcagtgtgagtatcggattaacgccctttgtgatgagcaccgcagaaagtgccgctccaagcggaaagcttccatctacggtcaaatccggaaaatccagtatggtgtatgtgatatatattccaagagccatgatcgcataaatcatgccctgctctaaaacgcttaaaactagtgtcacggtgtatcctcccctgctttaaaaatcaacgtaactattttacttcaatcttatcaaatgtctcggctgcatccttgatataatctgcatcaagtgtcatgccaatcttgtctgctgctgcagtgtttacataaagctctgcctttgaagctgtgataaacggagtgtcagaggctttctcctcaccctttaaaatctttgctgccatctttcctgtctcgattccaagctggtagtaatcgattcccattgaagcgacacagcctgatttaacctgctcaatttcacttccgaataccggaatctttgctccatttgccttgtcgagaacagtctggagtgcatttaccactgtgttgtctgtgaggttgcacaggcagtcaaccttggaaacaagatctgatgctgcaatctcaatatctgctgatgtgtttattccggtgtcaacgatttcaaaatcgtatttatctgcaagctccttgtactcctcaatggtgctgcatgagtttgcctcacttgtggtgtagagaataccgattttctttgcttccggcatcatctccctgatcatcttaagctgctcctcaacaggaagcacgtctgatgagcctgtgatgtttccgacacttgagccgtcctccttagcaagacctgctacaacaggatctgaaactgctgtgtatactgttggaatgtctgcattcatagctgaattgtaggcgctggctgcacatggtgtagcgatggcacaaatcatatcaaccttctcagatacgaagctgtctgcaatagtgcttgccgtaccggtatctgtctgtgcattctggtaatcaaccttaaggtttttaccttcctcgatgccctcttccttgaggccctctaagaagccctccctgcagttgtcaagagagccatgctctgcaaactgcgaaatacctactgtgtagctgtcaccctttgagccactctgtgtagagccctttgagccctctgctccacagcctgccataaggcccatggtgcaaactgctgctaaaattactgataatactttctttttcatattgaattcctcactttctttgtgaagtgtttgtttcccgatgttcgcgattttctcataaacctgccgcaacaagccaaatgtcatagcctcaaatcaaatttgcgctaacgacatttcatcatgtgggtgtttatgcaaaaaaccgcctcaagctaatgcttgagacggtaataacttcttattatcgcggtaccactcaatttgacgaattgtccactctgtcatgtactaatatacacgccgaaatgataacgggttcggttcccggtgacgcctactgatttaatcgttaaaactatgctctgtacaatcaaacgcttcggatcaccctcgaaaggccattcaacaaatccatccatgctgcaatcccaccatctgcagctctctgagatatccggaaaggtctactcttctttctcatcggttttgaaacactgttaaattaatctttttatatactttatgctctttttgctactttgtcaaggtaaagtttgaaaatttctatatttaagaggtgataccccatacattttcttgaagctgcgtataaagtagctcacattctgatatccactacacattgcaacctctgtaacggaagctgctgattcctccaatagctgcctggcgtgctccagcctgagatgattgatatactgcgacagcgtaatatgaaaatgctctttaaagtagcgggatatgtatttttctgacaaatgaaactgtgcaccaaattccttcagtgaaatttctcttgtatagttttgccggatatacgttatcatttctttttctattgtgttggtgccatttgtgccattttccagtatcagattattactccacattttccggatgaatttgatgagagttattttggtttcaaattgcgcctctatatttgcagcatctgtgttttctgcgtttttccctgatatctgtgcatttatctctatcagtcgctcgcatatatctgctgctgtatcatttatctgaggactaatcataagtctgcctcgtttaagaggggataggattgatttttccatgagatcgtccgtctgaaatgatatatattcaagaggaaacagaaacgtgtaataatctgcatctcctgtcggcgagcccattaaatgcagactgcccggagataccacaaatgcatcctttgggcttcctatatagttttcacctgatatggtcacatgcagcttgccctgctttacatatataatttccagctcatcgtgccagtgtaccggaatctggaatgcacgctttacatcactgatatggtattggctgaacggattttccggtgtgccgtgtggccggttttcttttaattcaaaatacatttttctacatattccttagtctcttttaatccccatccggtttgtttactataataatgatatatcaactatttttattttaacatattacatgcataaggtgtgcaattttttatttgttctcaaggttttgatgaatctacactgtaatatgaataatgactcagttatagataaagtagaaatagtacaatttttccttgaaataatacaagaattatttgtgataatgtaatatattgattgatgcatgcaagcttctcttctttatatcttcctctcccaaatgaagtttataataagaagtttgcattctttctgttaatatcgcaaagtatacatacattataaatgaggtaatctatatgcaggttcaaagaaaaacacttacacagctttccattccaatatgcttcgaaacacttttttacatgctgtcaggcatggtcgacactcttatgctgtcatccgtgagcgaccaggcggttggtgctgtcggcacggcaaatacatatatctccgttttcatcatcatgttcggtgtcatctcaagcggtatggttgctgtcatgacgcagaatatcggtgccggaaaaccgggtatagcatatcaggcaaggcagcttgggcttatatttaatgctgtaataggtgtgctcatgtctgtatttctggctgttttttccggtaatattcttagaatggtcagcattgcaccggcgctttttgattcggcaaatacttatctgcgcattgttggaggtgcctgctttttaaatgctctcataccgattttttcaagctacctgagagttttcggctacacaaagcaatccctttgggcatcaattattggaaatgtcattaactttatacttaacgctgtttttctctttgtaatgaattggggcgttatgggtgttgccacagcaacggttatttcacgtattatcaatctgattattgttgccacaatgggcgctgtgctcatcaaggcaaaggacagtcccgagcgcatagctcccggaaaaattctcggacagattataaagattggcttcccgtctgcctgtgaaaccgcgctttacaatatcgcaatgactcttgtagtgcgattcatgaaccagatggatgctgacggactgaacgtcactgcgcgctcttatgccacacagattgctaacttttcatactgtatcggtgctgccttagctcaggcaaatgccatcctgaccggctggcatatcggagcaaaggagtatgacgaatgtgataggggcactcgcaaggccgctatctacggtgtgattacggcatcctgcctttctatcacatttgcgcttttaggtaactatattgtacgaatcttcacgaatgacgtacagatgataaatcttgtcacaaagcttctcgccatcgatattgtgctggagcttggaagagtcaccaatctggtatatggtcaggcactgaagacaagcggtgacgccgtattcccggttgtcatgggtgctgttttcatgtaccttgcggcggtcggtggaacatacttcttcggactgcatctggggcttctcgcagtcggtgcctacatcggactcgcaagtgacgagtgcatcagggctgtcggcatggtgctgcgctggaagagcggaaagtggaagagcaagggactggttgattagagataacaatataaaattgcaatcgagtaggagggaaaattaaataaattttcccgacctctcacaccgccgtgcgtaccgttcggtacacggcggttcaatcaacttaacaagtggcacaccttttggtgtagtaatctaacattgagtatagcacttcaaacggggccagtaatccgttttaagaaacactgatcatctacataggaaacagccactttacgacacggtggcgtaaagtggctgttcttctgcactagcctagattacctgatgatcccaatcaactaattttttgagataaaattttgaaatacttcatatggtgagagttgcccaaaataacattagttttctcatcctattttcccctaaacataacatgcttgaaaatatatcaaaaaatataaatcccaagtcataactgacggaaatacctgctatgtagttacgaaatcaagctaatcttccggccacatcattttcttatcctcatcggacatctttatatatacagaaatcaatttttcatatattgtttttgccatccggcagcttctttccgaggccaaattaatattatttgtgttagtataattttcatggggacaacagcccaagcataaattttgtgcccaacacttagaacatttatctctatttcttacgtttatcatcttgaggaatttactgttgtctgatcctgtccaaatattacccaatgcgaattttctttcccccacaaagcgatggcaaggataaagagttccatcaatgtctaccgcaaacattgttcttcctgcaccgcatccattatttcgaacattcccaaattctattttttctaaagcatttaccaaatctgtcattttttttgcttttgcatattgctttgtcaaaataagctcttcgaaataaaaaatatagtttatgtattcagataaaattttgtcaaattgttcatcatctaccatgttttgagctatagctattggtatagcgcgaaactctaattcgttaagatggttaaatatttctttataatcagaattatctggtgtaacagtcgcacgagcagttaccaaattcatatgtctcatagatttagttttctctacaataacatcataggaacccttcttattgcgaaagaatcgattcatgtcatttttttcttttgttccatccaaacttatttgacagacaattttgttttctgtcaaatacttttctatgttatcagttattaacgttccatttgtagtaattgtatatgaaaactttttaccagtatctgcagaaatctgtttgcagtattcaacaactttttttaacaacggaaaatttaatagtggctctccacctaagaatgcaatatgtaataactcatcagtactattttttaccaagtagtcgatagcttgaaaggcaacgttttccgtcataatacctttattattatactcgcctccttctccatagcaataagagcatctcatattgcattcttgtgccagcatcaatgtcaatgcagaaaaatttgctttctctatctcttgagactcatcatgacttacttcatttctacaaagtaatttttcattctccatatcagttaaaagctcaattgatttatcttctgtaagatctatctttaatgcttcttttatactttcaaccgtactaccatttaattgtaataacttagatacggtattatcaatttcaaaaagcccacttgcataaatagtatataaatattttcttctctcaacctcaaaaatcttataaggataaaaatatattttatctgtatttaacattatcatttctcctcgtataataattattatagagaaggggcctatccatctatgatgaacagacccttctctttttcttagctaaaaacatcccatgaccattcatcgcagatgatacaaggccaacgattctctttgttttctttgctgttaatgcgcttaaacattctatcctacctctttttctcatgtatatttattagtaaatttgccaaaaagcaaatactaatctaattcacactgcaatccagttcatttattttatttattaatgtcaattttactcccaacaaggcaatgattagaagaattgcaattttcaaaaatgcatctgtcagagctggatttcttcccataatgggtgtttgcataaatgcaactaaacttccaataataataggtatcgaaactgattttttggtcattcctattatatatgggaaaagtgatagaacagatcccaaaatcacagaaataatcatttctttaatcccgtaaattataagctctaatgtaatagtacttgcagttacatcaaatatcgcttctgctattgtcacataaacaacacataacgcataactaattgcgatagaaattcccgtaaaggaacataccatagctaatttagtaagaattattttttctctttttatgggataggtaaacatcagcaaaatagttctatccttatattcgccaataatatatttggctgttaatactgatgaaaatatcacaaatgtacctgttactaataaattaagcattcttataatactatcatatgtatcttttgtctgttttggatctgtcattgaatcaataagagaaacagtaataaatgcaataatacatactgttgctataaaaatacccttaatatattttgttaacttatatttttttatctctaatttcattagatgtttcaagccaagctcctccttgtggttttaaaaaagaactcttctaagctgttctgttttttctggatactttccacacctataccatatttcatcaaagcactgctgatctcttttccactttttgataaatcaaacacctgaatgattccatctgatataactcgaaattgcttaatttgtaaaatttcattcagtatatatcctgctttttccgcattatctgtttcaatttctatataagccgcattttgctcgtggatgtctttcatagagatttcctgtatcatatttccatctttcataattccaacagtatctgctaacaattccatctcggaaagaatatggctggaaataataacggtgatcccatgttctttattaagttcttgtattaatcttcttatttctataatcccatccggatccaaaccatttataggttcatccaatattaaaatttcaggacgagtcagtattgcacgtgctattgctaaccgttgtttcatccctatagaatattgcgacacatgtttcccatcaatgttttttaatgagaccaagcctaaaactttatctatttcttctaaattaggatatcccatatattcacaatgcagttctaaattttctcttcctgttaactgttcataaaaatacggattttctataattgctccaaccttacgtaatgtctgataaccatttttttgaacagatactccatcaatcgtaaattcacccatatctggttttgtaagattaagcaacattttcaacattgtactctttcctgccccatttggccctactaaaccatagatttcaccgttaaccacatgcatacttacatcgttaacaactttacgatttttatattgtttcgtcagatgttctcccactattttgtattctttcatcgcctcgcctccgaactaataataagtataagctctgtttttctcttttttattttttaaatatcacttttttatcacttttttatcttccaattaaaaacagtttgtttatgaggaatactttttaccagaatatcactattcataccgtttgccagattttttgatattgctaaccccaaaccgctactttcatagtttttattcgtatcacttaatgtatatgatctattgaaaattttttcaatttcaatattctcaattccctgaccatgatcctcgaataaaacataaacttctttttccttttcttctacagtgatacctaaatactttccatcgtctccatatttaattgcattatcaataatatttttaataattctaatagcagctttcttatcaattcggacaaagatcgggtattcaggaatattaatttcaacatcatacccttttgtatagagtaaatcataatagcctaaaacaatttctctacataatgaagtgatattatatttttttatgtcgtatttaatatcacccgattcaatttgtgctaaattaaaaaactgattaatcaaacgtacactgttttttatttttattgaaagtttatgaattattacaacaatttcttccggcatatctattttcgatgatttctcttcaagtatttctatataaccggaaagtactgtcaatggtgttctcaaatcatgtgatatatttgtcataacctgttgcattgtctctttctgcttcttacaattaacttgtccgctataatatgcattcaataaattattaatactttttactaattctttaataggtacgctttcagttgaggttaaaattaaaccttgtgttgatttgatactatattcaatttgttccttaatagaattaagttctttctctaattgataaatttttcgcttttgcattacgccccatataatgacgcaaaccataattatagtgcttatatattccatacttatttctccattttataaccaattccccataaagtttgaatataatccatcttattactattatcaatatttaattttcccctcagcctattcatatgagaattaaggacacgttcatttccataatatggttcattccaaatcttcaaatacatttcttctttcgaaaaggctcgtcctggatttgatgcaagtaacaccaatatttcaaattcagtatgcgttaaatttattatttttccacctctttcaaccttatgttggtctgtatatattttcaaatctttaatttgaataatttcctcctcatgtgagacatttatatactttgtagcccttcgtatattagcctttattctcgcaacaagttctatgatagaaaaaggttttgttacataatcatcagctcccaaatttaatcctctggttttgtctatatcattgtccttagcagttattataataacaggcattacacttttctttctgattgatttcactacatcaaaaccactgcatccaggaagcattaaatcaattaaagccagatcataagactcctgttctaatgctgagattgcactttctcctgtataaactggtaaaacttcatatccttctcccgaaagataatctgttaccatttcactaatatttatatcgtcttccactattagaattttgtacacatttcttcctccattcgttaatactatagctactattataatttcattccgttcatccagctagtacttatcctgaattattcacgacactgtgattttgctatttaacacaggaccatagtcttgaatccgctcatagtacctcattctgccagagaactgcctaaaaaagggcagactatccctgttgcattgataagaggtcatttgtgaggatatcaaggttcgttgattgttgtcattcaaactgtgggtgcagattccggatgttttccagtgtctcatagaattatttcttatatgggaaactgctgcatagtttgaaatatttatatcgtgctgatttgactccccttgctgttcagctatacactttccactatctggacatgttcgggacttgcacccgttagagcgcgcccatggcgcgcaaacatataaaaaggaacctgttggttccttttttcatttacctgctcataaacaagtgctctctgaatatctcccgaaacagcttatcggcactccaaaatacattatctggtgtaacgacagccttacatccgattggttcaatcccagccttcttatattccgccagaaaaatatccatttgtgacgaattaatacctgaaaagaccagaagctccgccgggaaatcggctccgctatatcttgaaccatcctttttgaatccggttattccggctatggcaccgagcttctgtccgtaatctgacttttccacctgttgcaccgacattccaagagttttgcacagggcttttattttttccactttttgagctgctacaccaaatagcagtattttttgcgtagatttctgctgcattcttaatatctcctacttcaaggcaattatgtttgtaactatttagaacccaaaacctgcggttctgaatagttactgaattatttcatattgcatcagctcgtatttcagtctgcttccctccatgatttcaggtgggagcagtgcccttgccacaagcttcagatcgtctgattcgatatcgcatctctttaaatttgcatagtctccgtctatggaaactacctcgtaataccaggtttccatgtgttttcctcctaaatttcattttctaaagcatctactgataattccaattcactttgttctttgctttactgtaagtggagcaggtgtaattgtcctgtgcattggtgtactttcatgtaggattaccgtttttgtccttcttttcataaccgccggtgctttgtgtcaccgctttgctcatcatcacgggataatctctcgtagagtgcagtgattttgtttagttccggttgtttggttttcataagattctccttttaaaacaaacaaccagcttatctgtggttttattctaccacgaataagctggtttgtgtaaaaataattattgtctcactaataggcgattgatttaccatatatctaaactatcttcctaatccacccaagcctgcatctcgttatccaagaccaaccgggcatactccatagggttgtcaatggcaagagcgttcaatgcacattttgaatttggtgaaacacataaaaagctgctcatcaaatatcccccggataataatgtggaggatacaactagtacaccgagtaatattttccagctaaatacattgataaaatcgtacaaaatgagtataataatagtacgaagaaaggaagtggtgatatgtcaattacagcaactgaattgaaaaataatcttggaaaatatttattattatctgcaaaagaagatgtttttatcacaaagaacggaaaggtagtggcaaaactgacaaatccacatcaggacagagtagaagtagcaaaatccctgtttggaatcttaccaaaggatgcagacctgaatgaagcaaaagaagaaaggcttggtgcaaaatagatgaggattcttgcagatacaaatgtgataatagatgccctgacttcaagagagccatggaataaaagtgcagaagaaatatttcttatggcagcaaatcatacaatcgaaatgtacattactgcaagttcagcaacagatatctattatcttataaggaaacatttgcataacatagaagcagcaaagatgataatgggaaagctttattcattgactggaatattagaggttacagcggatgactgcatggatgcacttgcatctgcaatcagtgactatgaggatgcagttgttgaaaaggtggcatccagaaaagatatggattatattgtcacaagaaatataaaagattatcaggcaggtggaacaaagataattctgccagatgattttgttaaacttgttgaagaggaataatttttaccaccaaatcgtcaaataccgattttgtgaaactctttctatgctccatcctctgccttattgcagtcgattcgtaaaagcatattatcattagaacgtgaaacacattacagcctcctgccgcatttgggacagaattcaaagtcctctgtagttgtatatccacaattgctgcatctttttgttgtgtttccacttccattttcaaagccataaccatactgcgggtttacacgctgcaaatgctgtggcaatatctccacgtcctcgcctcttgctatcctgcgtcctatttccggatcaagctcgtaaagcgcattacagcatgtggtctgcacatagtagtgcctgttccatttaaaacacggaatgaagaacagtgacagcaccatgtatgtcatatacacctgatacctgccatacctgccacattcatcgcaggtaatgacctgattgaagtcaaagtccttcctgccgtccgttattcccatcataaaaaacatatatgatgcctccgtttatctgtgccatagtccccagaagtctccaagcgattctctcgtatgaaatccccgctcatcctcaactaccggtattgatttggcatccattttctctatatttacataagtaccctgactcaccattgcaaataccctgtctatctgctcctctgtgccctgtatttccataaataccgagccgtcagggtcatttctcacccagcctgttgcgccaacgctttctgccgcgtgctctgttctgtagcggaaacctactccctgcacagagccgtacactcttatctgctttctgatgattttgctgtcgtaatcactcatatgctcccacttccctgatacacattattttcagtctacaatagccctgcaaacagccgcataattgactgccccagccttcgccttgcacttcttccggtcctgtacttctccgtcacctccgctgactcagtgaaaagccttataaaatcatccctgatttcatgcaccacttcacaatccgccataaaacagccattttcaaaatggtgataaaggcttctgtagtcaagatttatggtaccgcaggttgccattatatcgtctgccacactcatctttgcatggcaaaagcccggtgtccactcaaaaatcctcacaccatgcttcacaagctggttgtagaaggagcgtgtcacgctgtatattggtttcttatcaggtatgcccggcgtgatgatgcgcacgtcaactccacgcttggcggcaagtgtcagcgcatggctcatctcatcggtaatgataaggtaaggagtgataaaccagcaataacgctgtgccttgtttgccatgctgatatagacatcctcacccacctgctcgttatcgagagggctgtctgcatatggctggataaatccactctgttttgcctcataatcatagtgtagcagatattgcgatacatccacctcgcgcggtaccttgcgctctgatgcattccacatctcgagaaatgcgatggtaaacgacttgacagcatctccctcgagcctgattcccgtatccttccagattccgtatgggtgtgtcacgttgaagtactcatttgccagattatagccgccggtatatgcgatttttccatcaattaccgtgatttttctatggtcacgattgtttaaaaacatgttaaaggcaggtgcaaccgggttgaacaccctgcatttgatgccaagcttctccatcttttccgagaaatccctgtctatgaaaaagattgagcccatatcatcataaaacacccttacctcgactcctgcctgcacgcgctccatgagcaccttttggatacggtgccacgattccttgtcctctatggcgtgatactccatgaaaataaatttctttgcctttgataaatcgctaagctgcgcttcgagtccctttgacgcctgatcataatatgttacatccgtgttctgatataccggataaagtgcatttttggccaggtatgttgaaattcccgctgcctgtggcaccttttcatacatatcggatagtatgtctgcgttttcaggcagacatggaagaagcatggaatccacctcttcaaaccgtgcacgcatcttattcggtgcgccgtttagtccgactaacaggtaaagtgacactcccattatcggaaatgccagtatcagtataatccacggtgtagtcatggatgcggtctgctcacgattgtacagtccgagcacaagtatgattgccaggacgcttgtggtcgtgtttattgctgccgcatattcatttagccttgtaaacatatagaccatgaaaactgcctgcaataatatcgcaagcactgaaaaaaacattctctttaaaccattctgtgtttttttagttccctcgtaggttttttccttcatctattatgcctccattatcttactgtctgtaataccaaacctctccatacatttttagctgccttcttatttaagaagccattcaatttcctctttataaggaggaatagtcttcttcgcagagctctcctcacaaagccatggtgtttccagaatctttggtacatttgcaaaggtctcatcatgcaccaggcggtgcagtgtatcatagccgatggttcccttgcctatatttgcatgcctgtccttgtgtgctccaagaggatttaagctgtcattcacatgaaataccgctatctgctcaagccctatcaccctgtcaaactctgcaaaaacatcatcataatggttcacaatatcgtatcctgcatcatttacatggcacgtatcaaagcagacacgcagcctttctttcctgtccactccatcatagattgccttaagctcctcaaaggaacggcctatttcactgccctttcctgccatcgtctcaagtgcgataaacacatcgtcatcattctgattgagtactgtgttaagtccctttacaatctgtgcgattccagcctgctcaccggcatttacatgacttcccggatgaagcaccagtatgcggctcttcattgccgcggtccttactatctccttttccagaaactccactgccagctcgtacgtctcaggctttacggtgtttgccagatttatgatgtatggcgcgtggaccactatctcatttatcccatgctcatgtgcatattcccagcctgcgtctatgttgagctcaaagatttcctttcttctcgtgttctgtggtgccccggtgtaaagcataaacacattcgcgccgtatgacgctgcttccctggctgatgccagaaacataccttttcctgccatgcctacgtgacagcctaattttatatcactcatatttttcctctgtttcattgaatctatatatctattatttctactataacactacatccctgataactctatctaaatattctaaatttttactaaacataacaaaagtcattgacatagtatcaaaaactacatatactatcctttgcaaccacatatattaatggcatataattgcaatgtatgtgatgcataactacagttaaccaattattatgattaaaggggcaaaataccttttgaccatcatatcattattatagaaatacgagggtaaatatgtttgaaataattgttgactctgcggcaaacattcctgcagagctatgtaaaaaatataaaatcaaggtgctatcatttgtaaaccttgtcaacggaaaggaaatgacctgctttgagcctgacctcacaccggaacaggagcgggcaaagggtaaggaatactatgatgcgataagagaaggtgctgaggtaaagaccggacttatcagcagcggaatctttgaggataccttcagggaaatcattgaggccgacaaggatatcctgtatttctcactcagcaaaaatataagcggcaactacaactcagcccgtgtcgcagccgacgctgtccttgatgagtgcgataacggcaggaaaatccgtctggtggattcattaaatgcatcccttggacagggacttctcgcaatatatgccagcgaaatgcgtgagaagggcatgagctttgatgaggtggctgacacgatagagacctatcctgccagattaaacggtgtgtttacagtgggcaatttaaagtatcttgccagaaccggcagattaagcggaaccacagctttggtcggcaacatgctaagcatcaagcctatcctaaggggcagcaaggacggatatattgtacagttcagaaaatgtcgtggcagaaaagccgtattaaatgagcttgtcaatctgttatgtgacaacattacagaccctgaaaatcagattatcggagtggcacatgcagacgcatatgaggattcgctctatgtgattgaacagattaaaaagcgcataaaggtgcgcgatgtgataaataccacctatgatttctgcaccggaagccatgttggcccggaagctttagcagtatttttcatgggaaaggacagagaattgggagcctgatatcaggctcccttttcacttcttttattcatcatcctcatataaaaaagtcccagaactcgcttattaagcggattctgagacttttgatttctattaattgcaacttctatctcattttaagctgcagctttcttgctttctgatttctctaagagcttcttcacaccctgaattgcaacaagtacaccaaggatgagcagtaatactgcgaatataagctgtaatgaatttccaaggtcaagtcctacagagaataatgcctttgtaagcttgtagattgtcatgccaagtgcagtaaatgtaactgccatcatgaataccattggaatccagagcatgcagccctgacgctttgtcttctttaagaatactgcgcaggcaacaagtgcaagtactgataagagctggttagctgaaccaaacagtggccagatctctgcatagcctacctttgtaagcatgtatgcaagtacaagtgtgatgattgttgcaaagtatttgtttgtcatcagcttgacaaatggactcatattgtcatcatctgtgtctgaatcaagccagaactcctggaatgacaaacgtccgactctggctactgaatcaagtgatgtcagagcgaatgctgatacagcaaggttaatcagtgtgaacacaagtgaatgtggtaaaccgattgctgacaggaagtttgcgatagctcctgcgaaaatctgtggctgtgttgtaagtccctgagctgctgcctctcccttaccaaatgatgctactgcgataagtgcaaggattgcaagcatactctccataagcatggcaccgaatgaaacaggaagcatgttcttctcattctttatctgcttagatgcagtacctgatgatacaagtgaatggaaacctgaaactgcaccacaggcgattgttacgaataagattgggaacagatactgtgggtttccgtttgcatcagggattgcaaatgctgtgaaagcatcaaggttacaagcaggatttgcaacaaatacaccgattaccgcacctacgatcatgaagattaacaggtagctgttaaggtaatcacgtggctgaagcagtgcccatacaggtgtaacactggctataagtatatatgcaaatataattatgtgccatacgctaaggtttaaatacattgggaaattgagtcccagtgctatagctactataagtaatacgattgcaacaagtgtgttaatccatttgttgaacttagaatatttaaggaagaaaccaagtgcaactgcctctatgatgaaaagcattgatgtagttgcaactgctccgttggctacaacctttgtaacctcacctgctttatcagcagcaaagccattgaaggttccggctacgacatctgcgaaggctgcaacaacaagtatacagaacaaccagcagaataacaggaataatttctttcctaatttaccgatgtactcctcgatgatgtaaccgattgtacgacccttgttcttaactgaagcgtacatagatgcaaaatcctgaacagctccaaagaatacaccaccaattaatatccaaagcagaaccggaagccatccgaaaatagctgcctgaattggtccgttgattgggcctgcacctgctatagatgcaaactgatgtccgaatactacattggtatcggccggtacatagtctactccgtcctccatctcgtaggcaggagtcttggcatttggatcaatgccccatttgttttgcagataacggccatataataagtatgctccaccgagcacaacaatggctattaccatcattaagattccactcatattattacctctttcttttgtttatcttaattttatttgtatattatatttactctttttttagcaaatttcaataaatattttatacataatttattttttatttctataatttttgtttaatttaccaatcggttataataggtattcattctctttatgctgtctttgtctcagcggcttcttctgcctttttagcagccattttgtcctttaatgcaaaggctccggcaagcagtgtgcctgagattgaatgccatgtacatgacactgcacagatgatggctgattcaggtgttgaagcaaactgtgctgtagtggtagcaaggtttgtggcaagacctgcattctgcataccaacctcgatagagatggttctcttcttggctgtgttcatgcctaccagctttcctgcaccgtatccaagcagatatccaagtccgttatgtaacagaactgccgcaaaaattactactcctgatgtaaagaactttgagccctgtgatgatacaacaccacctacaacgaatgccaggccaagcaccgcaatacccggcatgaccttctgagcctcggcaaatgcctttttctttccaagcaggtagttgagtaaaaatccaaccgctacaggaaagattacagtctcaatgattgacacaaacataggaagcgccttgattgagacatgtgttccgcttgcaagaaatgataccagaagcggtgtcataaatggtgagagcaatgtggaaactgttgtcattccaactgagaatgccacatcaccaccgcagaggtatgacataatgtttgaagaaacaccaccgggacagcagcctacgaggataagtccaagtgcgattccgtcaggcagattcaatgcctttgagataccaaatgcgagaaacggcatgataagatactgtgcgattgcacctacacatatatcaaatggtctctgtgcaagtatcttgaaatcctgtgtcgtaagtgtaagtcccatactaaacatgatgattccgataatgattgactgacatgtgaacttgttggataccggatccacaaacagcatctgatttacccaggccatcagattcggaaccagaaatgtgactacggcgattgctatgacaactatcgatgtgtagtctgataaaaatttacttactttttgtaatgctttcattgtaagcctccttaacatttttctgctcactaaaactcttttatggaattaaaaaatccctttccagattgacataatctgaaaagggacgaaataatccgcgttaccaccctgattccacagtgtattactgtgacactctgcataccagcatatgctttccatataacggtggacaccggcgaggtttacagacatgcttaatgctttcaacccgcttcttagagaggatattcctatctgaccattgcctgttcacaccgcccacaggctctctgaaaataaatacagaccggactttgttctcatcaacgaattttggtgaacatatttatttaaatcttgttttgtattatagccctctgacactatatgtcaagagaatgatacaaatttgtactataacatttatttatagtttctattcatacgctttattcttatttcttatctattatttattcacgcgatttattcttaattattattcgtaatctttgttgttatactcatcattccatgactgctgttgtgatgtaccgtaggaattttgagcatccccgccctgtgctgtgccatacggattctgaccatactgctggtttgctccgtttccgtacatgttctggccgtactgctgatttgtgccatttccgtacatgttctgaccgtactgctggtttgccccatttccgtacatgttctggccgtactgctggtttgctccatttccgtacatgttctggccgtactgctgatttgctccgtttccgtacatgttctgaccgtactgctgatttgctccgtttccgtacatgttctgaccatactgctgaccgtatccgtttgaaccgtatggattatagtagttattattactattatatccatctcccacataaacaatgtttttgttgaaggcaataatacagataaaaatcacattgaggaatataagtccgcaggcaaatccggctcccttgccaaacgcatgtgccagtccgacacagcagaggatattcataaccaatgccgcaatcattgctgcaataatcagaataaccgcaaatatcagcatgcccatgtgagccccgatacggtttccggcatatccataggtagaatcataatacgaccccatataactggatgtcataacggaaagtcctgaggcaataatctcatacatcaataaaatacatcctgctatacttgcgatacttgccacaagatatccccagaacagcttctgtttccctgcaatcctgaattttacatatgagctgtaaaacggtacaatggccgcccagccgtgctctcctgcctttgcatacataatccatgatgcaacaattgtcagtaccataactgccagattgataaacgacttaaagccgtcaatcatactcataatagtataatatgtgctatatgtgctcattttttctccctttcataaccaaagtttgtttgttattcaaagtatacatcaccacaggtcagagtgcaataattaaaaagcttttggagcttgtataattcactcattttaagattctaacaatactcctttatatattcaccaaaatatggaagtgcaagtgagatatagccctgtctggaatttaatatacctctttttataagacgatccctgtacatagagtagcttcctgacttctctcccataagcttaagcacttcttcacgcttgtattcttccttttctgtcaaaagtcctgcaagaaacctgtccatttcagtcatctcttcccatattttttcataagaatatgcaaacaattcagctttgagttttggtaaaatatcttctaacaattcatccaactttttcttaaaatacaacactcccaattcctgaaatgcatatgcgtatccttttgtaattttcgccatttcacgagcctcattactgtcaatatccagcttactcttatacatttcagtcattcgtatcatattaagaggctccgttttaactgttgccgctcttctgaaaaatgtaagatttttgacattgctcaattcctgtatattttcatacaagcctgtacacacaaaataaaccggataccctgctctgagccatctgccatattcagacgcaaattttatcatctcttcggactttgaaacctcatctattcctataagtatcttcttcccctttttctgtgcagcctgtatcattgtctcaacttctacaccgatatcaaagaaattattattgttttctgccgtatagccgattccaccacctgttcccatcactgttgcagagaggtttatccctgttgttttcttatcctgtgaaccaaaaccggcctttacaagcattgccgctatctgtcccagtatatctcttgcaggatttacatcaaaaacaagccagtttatatatctgctttcattggttcttaattcttcctccacctttgcaagtataacggttttaccggagcctctgacaccggttatcttatataccgactccgacggattatcgtaaataaagttttccagtatctcctctgttttctctgtatggatatatgtgtattccggagtcttactgaaggttgtagtaaatggattctgcataaattcacctcaatttattatatgaaattcaaaactatttatatttttttatactttatattgttctttatagttttttataaatttttatactttttcttttattttatacttttttatacttttttgcaatagttcttccgacctgtatataccgttaaagtaatcaccgctttttacagcccttgacaaatcccttcttaaacagctataatatcgtcaattgaagcataattacatttcaacaggctttgatgggaataagtacatttctgcaatacttacagagagctgccggcaggtgagaggcgcaagggaaacagatctggaatacatcccggagctttgcaccgaaagtcataccggatggttaaatatccccggttcgattaataagctgcaacgtattggcacacgttatagtgccggagtgttagcagaatcggctattttcactatatatatgtcagataatgtgtgacaactcacggaggcattcctgtgcgagcaggatgcaaattaaggtggtaacgcgagaaatccccctcgtccttaaatggatgagggggatattttatttttcagaatacaaattcaatctatcaggaggaaaatcatgacaatttatgacgaattagttgcccgcggtcttatcgcgcaggtaacagacgaaaaagaaatcaaggagcttataaacaatggaaaggctaccttctacatcggctttgatcctacagcagacagccttcacgttggtcatttcatggctctttgccttatgaagagacttcagatggcaggaaacaagcctatcgtgcttatcggtggaggtacagcacagatcggcgatccatcaggacgtacagatatgcgccagatgatgacaacagagactatcaaccacaacgtagagtgcttcaagaaacagatgagccgcttcatcgactttggcgatggaaaggctatcatggtaaacaacgctgactggctgatggacttaaactacgtggatgtgctccgcgaggttggtgctcatttctcagtaaaccgtatgcttacagctgagtgctacaagcagcgtatggaaaagggtctttccttccttgagtttaactacatgatcatgcagagctacgatttctacacacttttccagaaatacggctgcaacatggagttcggtggagacgaccagtggagcaacatgctcggtggaacagagcttatcagacgtaagcttggaaaagacgcatacgctatgacaatcaatctgctcctaaactctgagggcaagaagatgggcaagacacagtccggtgcagtatggcttgatcctaacaagacaacacctttcgagttcttccagtactggagaaacgtttctgatgccgatgttcttaaatgtatcagaatgctcaccttccttcctctcgaggagattgacaagatggaaagctgggagggcgcacagctcaatgaagctaaagaaatcctggcattcgagcttacaaagcttgttcacggtgaggaggaagccgcaaaggctaaagaggcaagccatgcacttttcgcaggcggagccaacaatgcaaatatgcctacagttaccgttacagctgaggacttccctgacggagagcttgatatcatctctgttctcgtaaaagcaggactttgcgattcaagaggagacggccgcagaaatatccagcagggcggtgtttccgttgcagatgagaaggtaactgatatctctacaaaatacactctcgacgatttcaagggcgagggtctcattatcagacgtggtaagaagaaatttgccaaggttgtagctgaatagacagagaatccccggtagttactaccggggattttttactttcagccatattttattttgaaaattcatttgcaggaaattcatatggcacaaatttactgctacatgtaactgtatactccgtttctcccgaaacagttttttgttctgtgccaacaccctccccacaaatccagtatgaaccatcatttttattctttagcataatatccccacactaaattagcatagtgtacaatagccatatgttgatagctgacaggccttgggtagctgtaatccataaaacttctaaaacagctccccaatccagtccaaaaactggaaaaattctggaaaaaagtagctgaaaccgctgaaatttctaaaacagctcccctaaccacagcgaaatagccggaaaaatctccaaaaaagtagctgaaactgctgaaatttctaaaacagctccctaaccacagcgaaacagccggaaaaatccataaaaaagtagctgaaactgctgaaattcctaaaacagctcccctaacccagcgaaacagaatggcttattatccatcatttatatatattaaaccctactttttcctcatcttcccttgacttctcattaataagttaatataatttatctaattgatacatcaacgctttaaagcgctgacaaaaggaggaattatcatgaaaaagagatctaaaattttagcttcacttgttcttgccggaacaatggttcttggacttgccggatgtggagattccggttcagcaaacggtggcacacagtcaggcaagaactcaggtgccaaatatcaggtaggtatctgccagctcgtacagcacgaggctctcgatgccgctacaaagggctttaaggacgcattaaaggacaagctcggagacgatgtctcatttgacgagcagaatgccgcaggagatgcttctacatgctctacaatctgcaccaagttcgtcaccaacgactacgaccttatccttggaaatgccacagcagctcttcaggccgcttcagcagccacagactctattccgattctcggaacatctatcacagactacgctacagctcttgatatgtcagactggtcaggcactacaggaaagaatatttcaggtactacagacctcgctccactcgatgagcaggctaaatgcatcaaggagctcttcccggatgcaaagaacatcggtatcatctactgctcatctgagccaaacagtatctaccagtcaacaactattaccaaataccttgaggacgagggatacactgtaaaagagtacacattctctgattcaaatgatgtcgctgcagtaacacagagcgcatgtgatgcatctgatgcaatctacatcccaactgacaacactgctgcttcatgtacagaggctatcaacaatgtagcttcacaggctaagaaacctatcttcgccggcgaggaaggaatcgctaagggctgtggtgtggcaacactttctatcagctactatgaccttggatacacaacaggtgagatggcttacgatatccttgtaaatggtacagacgtcaaaactatggaggttaagagcgctcctaagttcactaaggagtaccttccggaccgcgccaaggagcttggaattacagttcctgacggctatgaggaaatctcagctgaataaacagctgcactatggaggtatttaataaaatgattctaatgaattattttgcaaccttaaatccggttgcattcaccaatgcccttccgggcaatatagcccagggtctgatttggggtatcatggcactcggtgtttatatcaccttcagactgctggacttcgcagatctgacggttgatggctcatttgcaacaggtggtgccgtaaccgttatgatgacgattaacggctacaatatctgggtttcactgctttgcgcatgtattgccggtctgctcgcaggactctgcacaggtctcttacatacaaagctcggcattcctccgattttggcaggaatccttacacagatagctctatactctatcaacttaaatatcatgcagcgccacgccaaccaggcacttagcgcagataaatataatctggtgctttcatcacgtaacctgacacatgcgataattgtcggtgtgattttctcagttgtaattatcgcggtgctttactggtatttcggaacagagcagggctctgctatccgtgccacaggctgcaaccctgcaatgagcaaggctcagggtatcaacatcgacaacatgaagctcatcggtcttgcgctttcaaatgcaattgtagcgctctcaggcggtctgctttcacagtactcaggcttttccgatgtaaacatgggccgtggtggaatcgtcatcggtcttgccgcagttatcatcggtgaggtgctcggcgatgcaatcctcggaaagcacatgaatttcatgggaaaacttatctttgtcatatttggtggaattgtttactacattgtaatcggaattgttctgtggctgcagatgccaagtgatgacttaaaactcttcactgcaatcatcgtggcaattttccttgcggtgccttacctgaagggcaagagcaaagcctccttcaaaaaggccggcaagcgctctgccgcagcacttaatgcaaaggagggcaaataaatgctagagattagaaacgtacataaaaccttcaatccgggcacaatcaatgaaaagcatgcccttaatggtgtaaatctaaagcttgaggagggcgatttcgtcactgttatcggtggaaacggtgccggaaaatcgaccatgctcaatgctgttgcaggcacatggcctgtggacgatggttcaattctcatcgatggagtggatgtcacaggactccctgagttcaagcgtgcatcatttctgggacgtgtgttccaggatccaatgacaggaactaccgcaaccatgcagattgatgaaaacctcgcacttgcagcgcgccgcggaaagcgccgaggtcttggctggggcatcacaaaggctgaaaaggagcatttccacgagcttttaaaggagcttgacctgggactcgaggatcgaatgacttcaaaggttggtctgctctcaggtggacagcgtcaggctgttacactgctcatggcttcactccagaagccgaaggtgctgcttttggatgagcacaccgctgccctcgaccctaagacagccgcaaaggtgctcactctcacagacaaaatcatcaaggagaacagcctgacagccatgatggtcacacacaacatgcgtgatgccatcgctcacggcaacagactcatcatgatgaataacggacaggttgtccttaatatctcaggcgaggaaaagaaaaacctcactgtggaggatctgctcatgaagtttgaggaggtttccggcgaggaatttgcttctgataaggctttacttggatagacatatctatataataataaaaaaatttgcagctcgatacacgagctgcaattttttgttatatactttttatatgagttctcccaccggtttaatcatatcagccttgataaaaccctttatgatcagatactgctctatcgttttcacacagttttccacaccgacacgttcactgtttagtgtcaggtcgtagttcaccggattggtccagtagtttccgtgtgtatagtacttgtaataatctgccctgaacttatctgttctctcaatcgtggcatttgccacctccggtgtcacccccatattggctatggtacgctccacacagaatgcacgcggtgcctcaatgtatatgctcaccacatttgggcggttctttaatacatagtcggcacattttcctactatgacacaggattccttgtctgcaagctcgttgataatctggctctgatactcaaagagcctgtcatctgatttgaacttctcatttctcgatatatatccctttgctcttggaagccctcgcaaaaagctcgtaaatccgccctcttcacgcagcttctcatttacctcctgaaacacattctcgtcaagtccgctcagctggcttgcaagagtcagaatacggttctcataacagtgtattccaagctcttttgccagctgtgatgctattgcttttccgcctgttccaaatcctctggcaaaggttactacaaaattatccatttatcatttcctccttctgaatgccaaccatatctagccagccagatatctgcttaagaattctcttgttcttggattcttaggatttgtaaacagctctgacggtgctgcatcctctgccacatatcctgagtccatgaaaatagttcttgtagaaacatctctggcaaatgccatctcatgtgtgacgattatcatcgtaagtcctgtcctcgcgaggtccttcatgacatttagcacctctccgaccatctcagggtcaagcgccgaggtcggctcatcaaataaaagcacctccgggttcatacaaagcgacctggcaatggcaactcgctgcttctgtcctcctgatagctgcgatggctttgcattgatataaggagccatgccgactgccttcagatgcgtgattgccctgtcaaaggcctcctgctttggcagatgaagcacccttcttgtacaaagcatacagttctggagcactgtcatattgttgaacaaattgaaggactggaacaccattcccacctttgaacggtaatcattgatatccttttgtacatttctgacctctttatcgtgatataaaatctttcctgaggtctgtttctcaagcttgttgatgcacctaagcagtgtggattttcccgaacctgaggagcccacaatacagatgacctcgccggaatgcacatcaatatcaatctttctaagtacctcatgatcaccaaatgatttgcttaaatccttaattgaaattactgtctcactcatattgtgcctcctattcattgtccatgtactcaactgcgagtgcatagtctgtcttgccctgcagcttcttttcaatcagcttgaagagcttatcaaatacaaagcacagtacaaagtaaattaccgcgatgaccagatatgactcaaagtacttgtagtagtttccaccgactgtcttggcagccatgaaaagctcctgcacagcgataacattgagcactgatgtcatcttcagatttaaaaggaatgtatttgccatctcaggaatgatgttcttgaatgcctgcggcaaaactacatagagcattgtcttaaacggtgacattcccatggcccatgcgccctcgcgctgtcccatatctattgatccgattcctgctctgactgtctctcccatgtaggcacctgtatttaatacagttacgagaatacctgcaaatacaggtgtcaggttttcatatcccatctgacgtattccatagtacacaatcatcgcctgaactatcattggtgtgtccctgaatacttcaacataaactgtaaatatcacctttactatacggataaggaccttttttacgatgttgtcgccatcgttaagctttacatcatttactatgcctacgatatatcccaatacgaagccaagcaatgtaccaactaccgatatgtacagcgtaagccaggttcctttgataaacatgcttgaatatttctgcgccagaaataccatccattctaacgaattacttggattacttatcatcatactgctacctcacttttatctctctaatccccagcttacgccggtttatcagactattgtgggatgatgcgatataacatcatcccacagtccttcatcttttcgtgaatcagataaatctctaacaactagttggctgccggctgctgtgtcagaacctgatccatcagctcatccatctttgccttgtcattccagccgattgcattcatggcatcctggattttatctctgagtgctgtatcatcctttcttgttgcgatacatacatttaccatttcatcatcacctgtgaaggtatcattctcatccagctcgataatctgtaaatcatcatttgtcagtgctgctgactctgctgtcggaacatcgattacacatacatctgcgctgccgtttgatattgcaaggaagcactctgatgttgtctcaaagtttcctgactgctcagcaccctttatctggtctaaaagtggaatccagcctgttccaagctgtgtcgttactttgcagcctgtatctgcgagatctgaaagcccctttacatttgaatacttgccgcccttcttaacaacaatacagttgtttctatagtaataaggctctgtgaatgcgtatgacgcttctctttcctttgtcttgcccataccggcgatgatacagtcataatctcctgcatcgagggagataccgattgatgaccactcaaccttatgtacctcaaggtccattcccatctggtctgcaagcttctgtgccactgctacatcgtagccgtatgcataataatcagagcctgctatcttgactgccttgcttccgtccggtgtggtatctgtatcctgtgtccagttgaatggagcatatgcacattccataccaacctttaaaaccttctttgatgagctgtctgccgctgagctatctgaggcagctcctcctgatgacgaaccacatccaaacaatgttgtcgctgccattacacctgtcaatatcaatgctgcaaatctcttacttctcttcatcataagcttttcctccttgattattgaaatacgaaaaggcgccggagtttttctccagcgcctttgcttagttcgtataataaacttaatgaagcagctttgcaatgttaattttgcacaatttgtttgtgcatttttacagtaactaattaaacataagcctttttacaagaatacaattaactaaatccagatattccatcgagtcatcaaggctgatttccagtatttcctctatctttttcagacggtattgcagggaattacgatgaacgtacatcatctgtgccgtttttccgacattaaagccacacatataataattgagcagcgtatctatgagaaacgagccgtttgcattgtcatacatctcaagcctctttagcttctcgttgcaataatccatgatttcctgctgattaccactgttgaacatatacttgtatatgcccatggagctggcactgattaccttcttgttggtcggattgggtaaaatatcctttttggggatgagatttttcgcctcctgataactcttgccaaaatctgccggcttcctgtatgcagcaccgagtatgcatgtgctgtgaatgagccctgcaaatggtgcacgactgtctaaatccccaagtatcctttcaatctgatgctctgtctccatatcctttgtctcctcaaaaagaagcacaaatttgtttaaaaacctcatatacataggctttttcttcatatggataacctcgcggttcaggcagtcggtatagtatgtatatgtgtgctcgtcctgctccagattcactccgtatttgcggtctatcacgatgattcccactctgtatggccggtcaaaggtcagaccaagctgtgcagaaatcttttctatatacttatcatttacctcgtatccaaagagcagattgtacaggtagtccccggttcttttattatccacactggtctctaaaagcagttctccgacgctctgcgcaatatctacaaaagtagctccctcccaccggatataaaacaacggcagcttgagttcatcagccttgtccttcatcctctgtggtgcctcttccctgtcctccacaacagaaatcgcaaagcccgatattcccagctcattcagctcaaccatggcatcatatgcctcgtccatggaaaatctcttgtaatctaccacaagcagcgcaaagttgcccggattcatatgatccttataaggctttgtctgcaccagatacgtccatgacacaatccggtcaagccctgctgctcccgccacaagctccattccgtccatttgtaaattgttaacatccctgcatgaaatcatctgcgtctccctgatatcattaagcttcggtaattatcccaagccgcttcacattacttatatccacagccgcttcgccccggcatatcctctccgtgcacatacctggcattgaactccatatttatctcacgaagctccttctttccgtcgatatagtcctgatacatctcggcaagtcccgacatgcagccatcgcaggtagcctcgatattgccaagcgactcagccacaattgcctcgcgctcctcttttgttgtctcactgattaaatatcccatttcgtatatttcctttccggctattcacatattaaaagcccaaattctcatccacaagaataatctggaaacgtcccttcacccttgagaagcgtgtggtcagaatctgacagcagatacactgtgggctcttgcagtcaaagcaggtgccgttcttggagcatggtgtgtcgatgccaaagcgctgtgcgttgataggcgcagcctcatttctcgcacggctcatagcgtctgcctcggtttttacgaccttgttcatgcctactataagaagcacatgttttggtccgtaagcatatgccgctacgcggtttgcatttccgtcaatattgataaatacgccatcctcgctcatcgcattgacacttccaaggaaataatctgatgtaaatgcctttaacgctatttcctgcttctcctcctgcgtagacaccttgtccctgtcataaaactgatattctccgtttgagagcgcctcatacagaccacattccttcaccgatgtggcaccgcccatattgattgagctgccctttggaatcagctcaagtgccttcttaacagcctcctcctttgtctcgacataatatgcctccatgttgcgcgactcaagcgcagccacaaggcgctttcccagtaattcgtttctcatttttcttacgtccatagtgtaaacctcttttcatgcttattgtcaattccagtttgtgcaattagctttattaattgttgttattatactacttcacagggggtgtctgcaatttattcgggaataaataatcgtacttttcatgctaaaagaaaaaagtacataacaaaaagagccctttcgagctcttcctgctttgtacaacattaaattgtagatgattactgtaagagtgaaagtacaccctggtttgactgattagcctgtgcaagcatagactgtccagcctgtgcaagaatgttgttcttgctgtagttaaccatctcttcagccatatctgtatcacggatacgagactcagctgatgtagtattctcaactacgttgtcaaggttgttaatagtgtgctcaagacggttctgaacagcaccaagtgctgaacgctgtgaagatacagttgagatagcatctgcaattgcatcaattgcgtatgtagcatcctgctctgtatcagccttgattccctttactccaagtcctgctgagttcattgagtcgatgttgactgtaatcttgtttgtcatatcggcatcagcacctacgtggaggttgaagcttaatgaatctttgtatgaaacagttcccttggtaagggtaaatgttgtagttgcatttgcatagttagcatttgtattacctgcatttgcctttactgtagccgctgtatcacttccaatactgcttgcctttacgatttcagctgtctgtaactgatatgcttttccagcagagataactgttgagtcattgtcatcaataccatcttttgcatttgcatctttcatagctgtaagagtttttgttccgtcagatacaacatctccatcttttatcgtaatgcttcctgcagtaccgcctcctactgttacttgtgtgccagtatcattatcagtccattttttatcgtctgtatatttatatgttttaccatttacagttattgtattaccatttgtttcctggtctttgacaattttctgcgcatcagcagcagtagcaccaatcgtataattctttccagcaatactaatcttatcaccagccttaagctcttttaatgtaacttctacttcatcacccttatctgtaagtgtaacaccatcaagtcctgcatcatgtgcatttacattatgagccttctctgcaccgtcaccctttaagaggtatgtctcattgaattttgttgtctctgatacacggtcaatctctgttgtaagctgatcaatctcgtcctggattgctttacggtctgtgttagagtttgttccgtttgcagactgtgttgcaagctcgttcatacgctgaagcattgagtgaacctctgtaagagcaccttctgctgtctgtactgctgaaacgccatcctctgcatttgttgaagctctgtcaagtcccttgatctgctttctcatcttctcagaaattgtaagtccggctgcgtcatcagctgcacggttaattctgtaacctgatgaaagcttctctgtgctctttgactgtgcgcttgttgtcacgttaagcattctgttggcatttgctgcctgcatgttgtgttgtactaccataatataatcctccttgtcccatattcatgggttattatgtttgacctctggaaatccttttcccgaggtgtttcacacctgtcatatttctaacaaatgtgatgaatctttatataataaacggcttcccggctgtggtttttgccacagccgcttattatatttcattgtatttattttgttatttcgaatagcttaatccaaaattctgtgattttacttttcaaaagttaatcagtaaaattgattaatctaagctaccagatgattactgtaagagtgaaagtacaccctgatttgactgattagcctgtgcaagcatagactgtccagcctgagcaagaatgttgttcttgctgtagttaaccatctcttcagccatatctgtatcacggatacgagactcagctgatgtagtattctcaactacgttgtcgaggttgttgattgtgtgctcaagacggttctgaacagcaccgagtgatgaacgctgtgaagatactgttgagatagcatctgcaattgcatcaatagcgtatgtagcatcctgctctgtatcagccttgataccctttactcccagtcctgctgagttcattgagtcaatgttgactgtaatcttgtttgtcatgtcagcatctgctcctacgtgaaggttgaagcttaaggcatctttgtatgaaacagttcctttgttaagggtgaatgttgcagttgcatctttatcagcatttgctccatttttaacagctgccgctgtatcagttccaatactacttgcttttacgatttcagctgtctgtaactgatatgcttttcctgcagtgattactgttgaatcgttatcatcaataccgtctgctccagcagcatctgctccatctttcatagctgttaatgtctttgtaccatcagaaacaacatcgccgcctttaattgtaatacttccagcagcaccaccaccaacagtagcagcagagccatcagcgtttgtccattggttagtcttgtatgtatatgttgttccattgaccgttacagttttaccatcgactttctgcgcatcaacaattttctgcgcatcagcagcagtagcaccaattgtataattcttaccagcaatacttactttatcgcctgcattgagtgtctttaatgtaacatcaactgtatcacccttatctgtaagcgtaactccatcaagtccagcatcatgtgcatttacattatgagccttctctgctccatcaccctttaagaggtatgtctcattaaattttgttgtctctgatacacggtcaatctctgttgtaagctggtcaatctcgtcctgaattgccttacggtctgtgttagagtttgttccgtttgcagactgtgttgcaagctcattcatacgctgaagcattgagtgaacctctgtgagggcaccttctgctgtctgtactgctgaaacgccatcctctgcatttgttgaagctctgtcaagtcccttaatctgctttctcatcttctcagaaattgtaagtccggctgcatcatctgctgcacgattgattctgtaacctgatgaaagcttctctgtgctctttgactgtgcgcttgttgttacgttgagcattctgttggcatttgctgcctgcatgttgtgttgtactaccataatataatcctccttgtcccatattcatgggttattatgtttgacctctggaaatccttttcccgagattttttgtaactgctttgttttgctatttgcagtcactttgttgctttataacaaacggctttccgggttgtggcatctgccacggccgcctattaacgtaattagttatgctttcttatctgtttcagattttgcctttttctgtctttcattccagataatcttcttgatttcatgctgtgcttcctctgaaatctttggctccggataatatgtatcttttctcttctcaggattcggatcattgtttgaccttgagatattcatctctcttggagcatctatcatgagacgtccgttctttccgcttccaccggcatagaccactctgatgttgtctccgatgtttacatattctccctctttaagcgataatttaagcattctgtatacctccgtgcacttgatttaagctatttccatgcttatgtgaaatgtaacaattctctaagaaatgttgcattttttatcttacagttactatatcggacatcaattctaatactttacacctaattacaacttatttaaaaaatatatttgccatttattggtcatatctgccttttttaactaccacttcccacaaaaatccttgttcttagacgaaaaatgcaacatttcttagagaaatgttgcatttttcatattgttaccatattctttatcggtcaaaatcatataccttattcaggtattaatccccctccaaacatctgtgaaattcaatcagcttactgttttatgctttctgccatatatttcgcagtattgtaagcctaacctctgcaattgtcaaggattgcatactttttcgattgcgtaaatttaccatctaaagtagtggcttctgtaaaaaagccccatatcttttacagccatattccaaccacccttcttgctttcttttccacaccaagctttgaggcatacatcattagtttcgcagcatccttctttttatcaccaatatccaatcttgatgtttcaataaaatgcggttttatgataggaaaatccatcttgaatttgtttcttgcagacttattatccacagctatatgccagactcccggcgcccgatccgtataaccataatacatcgcagctgacatatcacagatgccgagaaaaatcaacttgctacataaagtaatatgtttttcctgtcttcccccgcacattttatgttataatcatctgacggaggtacatcatgaaaataactactctatgctacatagaacacgatgaacaatatctcatgcttcatcgtattaagaaagaaaatgatataaatgaaggaaaatggattggtgttggcggtcacgccgagaatggtgaatcacccgaagaatgcttgctccgcgaagtcaaagaggaaacagggctcacactcacatcataccgtttccgcgcactcataacttttataagtgataaacaggagcctgaattgatgtgtcttttcaccgctgatgaattttccggcaagcttataacatgcaacgaaggtgacctcaaatgggtggataaaactatcgtgcccacacttcctacctgggaaggcgacgctatcttcttaaagctcctgcttgaaaatgaagaaaatttcttcacacttaagcttgtatatgaaggtgaatcactggttgatcagaagcttgagatttattagtattatcctgccacaaggctatttacaagcgtctgcatatctgcctcccagtttctttccctgctataataaacacagccatatatttccgggtatttgaggttcacgctggagcagagaattacaggtattgtgattttgttcttaatcactctgtcaatcagaacatcccctgattgttcctctctgccgcccggctcgtcgggataatacatatcagtaattatcagatcatacggattattactatctattgagtttttaatctgtttccacccatccgcgagattattggaccattcgacttctttaatcccacatcctgacagggctttgcaaatatcatggtgtttaaatgtatcatcttcgatattcagtactctcatgtgaatcctgccactcaaaatgtgttcaaatatactcaaacacatcgagaaattaaagtccttgcggatacttcttactgcttcaatgtgtatgctttgacgattgtaaacaatacgctactcacaagttcgtgtacactccacagtcgtaaattcctgcgatagcccgcagtacatacttacgtttgcgtttattatgcaacttcgtaagttaaagcatctcttagattaagagcggcattgaaatctctatcctcaacatagccacaatcacaacggtatattctatctgaaagcttcaaatctttcttaatagcaccacagcaatgacacattttggatgatggataccatctgtctacgactcttaattcaataccattttcatcacattttgctttaagcttggttctaaattcataaaacttctgtgacgcaacagcttttgaaagatgtctgttcttcatcattcctgatacattcaaattttcaatagttatataagatggcttggttttcactatctcagctattgatttattgatataatcagtacggatattatctattttatgatgaagtctttgtactttgagcttttgcttttgtatattctttcgagtggactctcctttctttaagttctcatattttcgtgagagacatctttgttctctacgcagtttcttttccaattttttaattcttgttgacttattgatatttttataagttttaccattggaaacaatcgccaagtcttttaaacccaagtcaattcctataccaccattgctattattagcaatcttaacgtcgggaatttctacaagaactgacacataatatctgtctgctttgacggatactgtaccgcttttgattttccatccgtctttagttgttggtatataacctttttctttaatgcgtacccaacctaaagtgggtatgttcaacctatgtctctcacatctacagtctttagtattgttctttacgaaatacatttttacatcagatttacctttctttttgaaattaggaaaagcgctttgatgtttaaaaaatcttgtaaatgcagtacatccatcttcaatagacttttttacagcttttgaatatgcttctttaatccatattttatcaggattattaggaatatactcattattaagccatacgctgaaactcttgccagtcataaacttttcaccgttatcatataaagttttgttgtgaccgagatagaagttatagacgtacctacaagtgccaatagtcttgttaatcttgattttttgctcaatcgtcggatttatttccgtcttgaagctctttagcaatttcctcatccctttctatttgttttttatacttacgaagtccatacaacctcctgactttatctgtttaagtagtcattccatcttgcatttgtctcctcaagctcatgcttttgcattatgcgattgcggtcgctgagtatcgcaagcatttcatcggcgatttcttccatgggaagctttttatagtgtgacagatatcctatcatcctttgagctgtccagtcggtatttaggtttttcgttatctcatcgcaaaacggctccggatacccgcgcctgagcaatatatcatatagctccatactctttgctgtccttggtttcatatagtgcctctccaatattcctcatctttgataactaaccctatactcttaagattttctatctgttcctcaattgtcaaaggcggctgatgctgtttcatatctcccatttgacatttctccttaaaattaaaagacccaacgtggtccgcatcgttgagaggcgtgttgggttctgttagcttattatattcatctctcaagaaaaaaacaatctctcagaagcaaaatttacattttatttacaatttatgtttctgtcaaaactcaagcttgatgctagcttaatactacacgtattgtttccttaatgtcttaatctcctgtgtattattttgtaatataaaaatcatcgccacccacgttcagatgatactgattccccaaaaatgcaaaacctgccgttgatataaaccactttctatctgatgcacaagaacatttcgagaccaaccattttgcgctgatttttcaatataccatttacgctcctctggattggctatcttatccataagaacaatattgtgtccccatggaatttgtatcatttgcataatactactaattacattttgttgttcatcaagcgatcactttttagcgatcgcctcttctattattttgctctatatccatctttcgatttggaaagagttccatccatatatctctttgttcaattcagttcgctccttattcatacaaaatcatcaatctacaattctgtactcgtaaaggaaagggaaatcacttttgcaaaatgtatcataaatggtatgctgtatctacaggatggaattgagagacaatgtaatgaaatggaaaataaatatctgctgcatatccgggacagtgttggaattcctggtcactaaaaaaatctccattggctgacaaaaccaatggagattttttattttttaaagcaatacctgagaattggttccgtaaaagatatcatcatgaaaagccagtttcttcaaaatggactccatatattcccaattatcatctacatcaaattcatagctgtgtccccagatatataacaactgtggttcatccgtatccatatttaaaaagcggtcaatcccactcataatatctgcatctgcatgatggaagctaggcttaaacctcaacaggtcggattgtaaagcaaaaccatgtgtatctcccgaagttcttgcatactgtattccgcattcctttaatattctgaatgccgattcatcataagtgccaaaggggaacacgaatcctgctattttctgttcatagaaagcttcaagattcctgatatctgttgaaatttcattgtatacagtttcctcgtcaagacccttcagattggcatgggtcaaggtatgcgatgcgatttcatgccctttgtaaagctccctcatatctttctgattcatcctgtggaccacgatatttccctgagtaaatgtatcggctcttgtctggattccactattctggttaaatgttgctttcattccatatttgttaaacaatgcgatcaaccgtctatcctgttctactccgtcatcatagctgaaagtgaccgctttcttcttaccattccacataataattaccatacctttctataacctgcaaacttttctgtttcattgaaaaatcatctgcgcaaaatccgcaaagcaatgtctccacacattccagtcatgctctccgggataaatccttctgatttcatgaacacccttttcccggataatttcatcctctgccagaaacctgggaaggaagctgtccttatcccctatacagcgcaaaaatgtatggaaatagctgttgaacgccggattatccattgcctttaaatgagtctgctcataaggctttctgttaactacatccctatccgggtttccttcgataaaatcccttaaaaaaccggagaagattccgacttcgctaaacagatctgggtgatcgcatacagttcttgttgtctgtacagaacccatggacaatcctgccataccacgtttctccttgcatccaccaaactgatactttttttctaccatcggaataatctcttctaccagcatccgttccagcagaacatggtttaatctctcttctaaaccaaacttttcttttaccatgccatcgcacatgacaatggcaaatggttttatttttcccatttcaatcaaattatcaagtatgatatttgctttccctgttgttgtccaggaaatctcactctcaccgaatccatgctgcagatacaggacaggaagccccgcagacggtacacatggcggaagataaacaataaaccgttcccagttattggaaatacctgacatataaaattcgtgtaccagtgttccatgtggaatatcccgtatttccgtcagctcatttccatccggcagttcaatataattatataaatggcagtatccatgcccgatgggcagttcaggaagcagaacctcctgtccgtccacgcagatctgtacataattcactgctgtggagaacggaagctccagaatccattttttcccattttttgtaaatggatatgttttctcccccagtttcatagaaagctcttttgcattttcacagtccagctgtaaataattttttccgtctttttggaaaagcatgctgctttgttccataaataccctccttgctgcaagtaataaaaccatctctatatggtgatattctcagaatttcatctgtctgcatgttctgacaccattgacataaatgtcatttgccagttctgtaacaagccgcatatcctgccaggtttcacacttattccctataaaagtaatgttatcaaaatggacatcatggacacgtacttcttctgttggtgtctgatacccccggattatggagaccgggatatctccgttcagcacctggatattatcaaaataaatatcattgatttctcctttggcaagctgttccgtatatctgcaaagcagaaccttaatatcgaacagtttctgttctgcctgctctactctgatatttttataatgtatatcatgaacatggccgccatctgcctgatggatggaaatcgccgcaccacccatgtttccttcatactggcagtgtataatatcacaatcctcaaatactaggtcgtggatttcgctctggagggaataaccaagctctatggcattaccgggttctgcattccagatcacgttattgtgaacacgcacttttgttacgtcacgtaccgttgacggatcttcaaacaatccttgggatttgatgcagatactgtcgtctgtggaacgaataaagcaattttttacctctacgtcctggctgctcgtaatatcaataccgtctcccgttacaatcctcgacataatattcatatcatcaatcacaacatggtcacaagctgcaggaactacatgccaggaaggaccatctacagcagtaacgccttttaagagtacattattacaccacttggcatagataaagaaacggagtgcattactgtccggcagatgccagcaggctccgttaataattccgtttcctacaatggaaatattgtcacaatggtctgcgtatacacaccctgatacaacagcaccttcctctatgtaaaccgtatcattggactttaaggtaagaactcctacattatataccttgcccctttcaaagcagatggtggtatctgccggcttctcaatcctgtgcgagcaaagcacaaacaatgcatcatgaagaccaccatctgtctctacagtaaactttctcggttcatcaagatggatatggactgttcctccttttacagaaggaactatgccaaagctggacggacggatttcaagtttttcatatggtgtatggattgaaatctccagatcatacgcttcgttatctactactacaacatagtcaaacgaatctgtatggtataccacacgctctgttccattgcaggtaacactgtattttgttgatttttccagttcatctacggattttaaaataaatctcggttccttgaccgggtccggattaggataataaatcaaatcattttcaaaatccttcatgtctctttcctcctatgcttgtataatgttctcagaaacaaggtggtcactgctgtttccaatactaatacgcagtttcattccgccgctgacggtttccatgtttttgccataatatgagaattcttcctggtcaataaagaaatctacatccttcttctcccccggtttcaggaaaaccttctgaaaacggacaagctctttcttgggacgtactacagatgcatataatgtttcataataacactggactacttctgcccccgcaacattccctgtattgcacacattacaatgtacatgtacttttttatcctgtcctatctgcacatcaacgtccgaaatatcaaactctgtataggacaatccataaccgaatggatataacggcgtattcgggatatccatatatctgctggtgaaacggttttctgaattatcttctgtaagtatatgtccggtttttacatcccagtagcttatgggcacctgtcccacacaccatggaatactcacagataatttgccggaagggtttattctgccatacacaatatctatgattgcttcagctcccatagttcctggtctccaggccataatgacagccttggatttttctgatatcctccgcagatccaatggtcttcctgcaattaccacagtcacgatattacttgtacgttctgctattttttcaaataacacctgctgctcttccggcaaagtcaagaacgccctgctggcagcctctcctgactgggattcatgttcccccagtacacatacgaccgtatcttcatgggttatcgtttccagccactgctcatcccttggcttgccagacaattcctgttccacctgccataccttacactctgcatcagaaagaatattacatccagtaatacattctacttctatctgctttttttgtaaaacatcttctattgtttcaactgcctcatgttctccaaaaattgaccagcggcttaataattctcttgacgttgtataaggacctgcccatataactttcttcttcatgcttaatggcagtatcttatcatttttcaaaaggacacagctttcgcctgccagctgatatgccttttcccggttatgcagagtcagttttccactctttccaagaccggcaaacggattttcaaaaagccccagctgatttttcatcatcaggaccctgaatgcactttcatcaacaaacgcttccggaattttgccgctttccaccagtttttcaagacacagcatataagcaggactcatcatatcaatgtctacaccggcttctgaagcctggattgctgcttcttccatatcagctgccactccctgttcttccagctggcctatggagccccaatctgaaattacagttccctcaaatccttccttatcccgcagaagccctttaagaagttccttatttccgcttatcggtttacggtcaatagcattaaaagctgtcatgaccatagcaggctttgcttttaatgccatacggaaaggttttacatactgctccagaaatgtccgctgggatatttcaacatcattatattcccttcccgcattcacagccccataacctgcaaaatgcttcaggcatgccgctattccggtatcagctttctgctgatagccatctaccattgcttttcccatgattccgtttacatatgggtcttctccaaaggattccatcatccttccccatctgggatctcttgaaacatcaatcataggagaaaatgttgcccttagcccttctgaagatgcctccgaggcagctatagaagccgcctcagacaccagttccggatgaaatgaacacgcctgccccaacggaatcggagctatggtcctgcacccatgtatgacatctgccataaacagcaatggaatatgatggggatgctgttccatatatctgctctggatatcataaattttatctttaccgatcactccaagcactgaaccggcatattgaatgatccattccggtggcaactgttcgccaacaacacctgtgagcactgcctctttatcgaagtatgctccagtgagctgcaccatctgtcctattttttcctgtaatgacatttctgacagcaattgctgtaattcatgtatttccataaatactccttatgtttaatccgtttatttctaatgttcatttctccatagatcagcccgaagcatataagaccgtattttactcaaagtagattgtcttgccactttctgcggactggtagattgcttccagaatacgtgtgacaactgcagcctgtgcaggcttcacaacctgttctgccccatcaacaacgatgtggtaaaacaattcctgttcatagtctgctgctgacttttcttttcctgagaaaaatgctactccaccgcttgataattccggtttctctactacctgtgtattatggtggatgtaattgatcctaaggccatctttcatatcagctccggctttggtaccacacaggcttgtttttgcctcatcaacctccagtgtgttcagtgcccaggctgattccagttcgatcactgccccatttttcatacggataaagccaaaagcagaatcttctacacagaacttatccggatcccagttaccaaatgcatttccctggtctgtctgatcagacagcttgtggaaggaagctcccgtaacagactgcacttcataattatccatcatccataatgtcagatccagtgcatgtgtaccaatatcaatcagaggaccgccgccctgttcttcttcattcaggaacacaccccaggtcggaacagctcttcttctgagtgcatgtgctttggcaaaatagatttctcccaattcatcacttttgcacatttccttcagatacaatgaatctgtacgataacggttctgatatcctatgttgagaactctgtgtgttctttcagcagtttcgaccatcttctgtgcttctgcataattttttgccattggtttctcacacatgacatctcttcctgcctccattgctgctatagagatttctgcatgggaacggtttggggtagttacatatacaacatccaaatcttcttttagaagttcacggtaatcttcaaatacttttgcatcttctgtgccaaatttttcttttgtctcctgcgcacgctctatgatgatgtcacaaaaagccaccacctcatagagaccacttttctgcatagccgggagatgttttccgttagcaatccctccacagcctacgattcctgctcttaattttctcatggtatttcctccttatttgcacttttctgtgttatataacatatttctccagatatcttttactgagaattaaagacttctccaccttttccttggaatcctcaaatgctttatcttctatttcgatacatgtacagccatcatatcctatatcagtaagtgctgacacgtattttccccagtccacatcgccaagtcccggaatcttaggtgacatatattccagcggataagccatgatgccacaggactctaatttatccttgtatatcttgatatccttgtaatgaacatggaatattttatccttaaattcataaagcgggcggatatagtcgatcatctgccagataaagtgggatggatcgtaattaatgccaagattatcactgtccaggatcttgaagacctctctccagattggcggagttgtcatcagattctgtcctccgggccactgttcctcaccaaaaagcatcgggcagttttcaattgctatttttacgtcacatacctctgccagttttatgattggtggccatatttcttttacaagttcaagattttcccgtacatttttggtctgatcccttccgataaatgttgtgaccatgccaacacctaactttttacttgcacgtatgacattcttcagatgttcaatagcagcatttcttttctctttatctgccgtcattacgttaggataatatgccagtgcagagatttctactcccgctttttctgcatatgccataatatgggctgcatattcatcatcctggtttaccctttctgcatctatatggcttacacccgcatatcttctttctgctttttcttctggccagcatgccacttccacacattcaaatccctgctctgaagcaaaatccatcatttgttcataagtccatccgtcaaggattgatgtaataaacccaagtttcattgaaaaatcctcctgtatctgttttccctattttgcccatggagttggtgtaaaatctccacccctgcaccatttcagataattcagtgcatgaagctgtccggtcatctccagttctccggaatatacaggatcatggtatccctcaatgcagatatcgtcctcatatccgttacttcttaaaatagaaatgatatctctccagttcgtgtcaccaaagcccggcatacgatgccatacaaatgggactgcgcctgatatgccactatgtcttacagcatcccagtctattgttgcatcttttccatgtatatgtactatttttttgcaccattttctcagctctgttaccggatcgataagctgtaccatctgatgtgtcggctcccattccagtccgaagttatcattctttacttcctcaaacatcacttcccacgctttagggttaaaaccgatattacatgtcgcatgttcccatgttccatccataaggcaattctcaattcccagcttcactcccttttcttctgcaagatcagccagttcccggaataccttgccaaactcttcatatgcggattctaccggctttccttcccacgctcctgcaaaagtactcacatgtgtagctccgaattttccggcagtgcagattacattttccagtgttttcctatgctctgcgtactggataggattgcaatagtatccaattgtcgtgattttggaatccgtacctgccaacagtttttccgtgctcaatgccagcttatcaaggtcagtcccttccagtgacatatggaaattaagagaaaatgtctcaaatccttttccaataaatccctttaaccattcttctgccttagctccaggaacgcatgttcctatttttatctgtttcatacttattttctcctgttccttcataaatacttatgattcatactgtctataatcaatcaccttgtttgtttctgctgattggaaaatagcttccattagtttcattacacgcatcacctggaagagcttaatctccggctctgccccatctcttataactgctgctacattcctatggaaatccgcaatatctccggacacatgtggcagctcttctttcacgattgtatcttcccgtctcggagccatggttttggtcagacctgctgctgtctttactggcactactttctcttcggttatgcctgttttccgtatgatctcaccatttaactgccagtccctgattaccgcagtaccatcttcacccagtacataccatcttggcagggaaatataattattggtacctacttcaactaagacttccgttcctccttcaaatgtcaggattgtggtgaacccatcatccacttcctgattggtaatatgggtaagtgatgcatatacagtttcaatttttctatctccgtaaagatacagaatctgatccagcaaatgtacaccccagtcaagaaccattccgccaccatgtactttttcttttctccagtcacccggaataccccttgaaccatgcacacggctttctatccggaagacatgccccagcttctgttcctctacaagctttcgtatgatcaggaaatcatcatcccagcgcctgttctggtgtactgtcaggaactttccggtttctttggcaacattttccatctcctgaagatcagaagatgacagagtcaccggtttctctgatatcacgtttttccccgcatgcatagcacggattgcaatcggcttatggcagtcatttggagtggcaatcagcacgacatcaatatccgggtctgataacatttcctcttccgagccatacacagaaaaacctttttcttttgcttctattctcttttcttccttgatatcatagataccaccaatttcaatttccggtacatttgacaggatttctgtatgccatctgcccattccaccatatcctatcagcccgtagattactttgttttcccgcattttatacctccaattaaggaacagcggctaatgaacaccatcagccgccgtctcttttacttacttaattcatcgttgatttctttaagaatctggtcaccgccctgactcttccaatttttaacgaaagtatcgaattcgctgatatctgcttttcccgtaatgatctttgcgaaagtctcttcctccatcttcttcaggtttgcccatttggcttccatggtttctgtctgaccattatatgcattgtaaaccggtacatatttatcatttacataggaagctcctccaaccaaaagtgatacaagtctcgggagattagtttttgcaatgtcactgtccagattccatttatccaggctgaaatcatcataaggttcttttttcagttttttaactgcttccatatcattctttaacaatttatgctttgagaaatcgacatcatccattgtaatctctcctgcaagatatttttccagagtctcagtggatacttcaatctcatctgcattatcgtagacattatacaaaggataaaaatctgaagtaaccatttctgtggaggtaatgccatctgctacccactgctgctgattagcaatcagatagttaacaatcttaaatgcagcctccggattcttacagtttttgcttgccactacatatttacttgtaggatttggcatatgggcataatagtttccatcctcggccaatggtgtaaagtatgctctccagtctgcttctcctgccagtgtagcatctgccactgtataaccactccaccatgctccaaagaaaattcccacctttccagccagaagaggctccttacagtcatttctgacaagcatttccggatcaatcagtttatctttatacaatttctggattttttccagggctgttttggtctccggctgaattgaaccatactttacagttccatcctcatcctgcagccagtactgtggataagactggaagctgctgaacaatggatccagtccaaactggtttgctccagttgcattcatatgatctgaattgcctggtccaagaattccaatggtatcagcttctccgttgccatccggatcctgggtcacgaatgcttctgccactgctgccatttcatcccaggttcttggaacctccagcccaagcttatccagccaatcctgacgaatccacatttcgttcatttctcctaccatcatactcggagccgggattgccatcatctctcccttatcattagtaatacatttttgcagttcatccccaccggattctacatatcctttcaacgtatctgaagcatagtcatcaaaatactgatcaagcggctggatcagatcatatttcagaagtgccctgtactgtgcagcattgacattcatcagatcaggaatcgcaccacttccgatacacaggttcattttctcatcaaagtcagatgaggatgcaacccagtcgtatacgacatcgatatttaagtctttcttcaaaagtcttgtataggaattatcctcatagctcattccgtcaggaatcttcgcatttggattcattgaaccgcccagatggacctttactgtatctgcatattttgaaaatgggagatcttccttggctgttccttctgcctcacctactgctgttttctgtgtgttttcttctgatgttttgccgcatcctgccagcgcagtcgcaaccagtgctgtcgcacttacaagtgcgataatctgtttctgtttcatacttcttcttcctcctttttttatccttttactgatccaagtgtaataccatctacaaaatatctttgcaggaatggatatacaatcagtaccggtatcatagctataaatatctttgctgaatccaatgagagattatttaatttcatcgcctgtgcaatctgttctacattcattgtagaataatccagtgttacagccatctgctggatataggtctgcagtgggtaactgctttgtcttgtactcaggaccattccctggaagaattcattccagtacatgaccatggtaaaaagtgcaatggttgccaccatcggttttgccagcggtatgtatatggatatcagattcctccacggtccgccgccatcaataaaacatgcttcttccagctctggtggaagatttttaaaaaagttcactgcaaggattacattaaacacctgtagtcctgttcccagcaccagtccccagatactgtccatcagatggtagcttttcatagtgatataccatggaacagtaccaccgttgaataacatacaaaatacaagaatccacatgaagattcctttatgggggaactgctttttcgttcttgacaatgggaacgctgccataagaacacataccatgctgatagcagtacccagtactactctttttatagatatcaggaacgaaccaaaaaatccactttctcccaaaatcttctggtaggagagcagattgaagccaaccggccagaaagcaacttttcctgcattaacggcttccctgctgctcagggatacacagaggacataccatacaggcataatacagagcaacataactataacaaggaacaccacattcaaaacatcgaaaatcttggatccgaggcttttattctcaatcatagataccacctcctaaaacagtttataaccggtaaatttatctgccagccagtaaccaaccgtaatcaacacaagactgatcacagacttgaataatccgactgctgttgccaaagaatactgcagattctgtaaaccagccctgtatacccatgtatcaataatatctcctgttgaatataccaatgggttatacagattatatatctggtcaaatcctgcatttaatacattgccaagagacaggatagccagaagtgctactgtcgtccttatacccggcagcgtcacatgccatatcctcttaaacctgccggcaccatctgctgctgccgcttcatacaatgatttatcaacacccaggatagcagcaagataaactactgtattataaccgaaccctttccagatgtccgtaccaatcaccagcggctggaacagctttgcttccccgaagaaattaatcgggtcaccgccaaacagctgtatcagatgatttatcggtcctgtataaccgaaaatgttcagcacgatctttgcaagaataacccaggacagaaaatacggtaagtatacgattgtctgaatcggacgcttcagtcttttcaatgccagttcatttaataataatgcaaagatcagtgggaaaataatatttccaatgatcttacccacagcaatagttactgtattacgtaaaacctgtgtaatgtcactcatctgaaacatatacttaaaattagccagaccaacaaatttggaatgcaggatgccctgtcccggattataatcctgaaaagccatcacgattccaaacataggcacgatactgaaaaagaacagccacaggaaagccggtaccagcattatgtaataatgtttcacaaaccttttaatgtacatgagtaaacctcccttcctttttgtttaatatacactatgatacctccctttctttttttaattattttatcttcttcccccatatcctgctagatgatattgtttctaattttaccaaatattttttatcacaaaaaaaatgtccgatgaaaatcagacatttttactctcttttctgtattccgaaggcatacacccatgctcccgtgcaaatacttttgcaaaataatgaaaattatcatatccaagttctacggcaatccttgtaatgctcttctttccctcctctatccattccgccgcagtcttcattttcctgtgtatcacatattggtgaaatgtttcccccgtcacctccttaaaccttgtactaaaataactcctgctcatccctatccgttctgccacgtcttcagagcgaagatcctccccgatatgtccatccacatacttgataaccgctgcaaaagcactgatatcatttttctgtgatgagctaagactctcttcataaatatgttccctccagcggtgcacccagtccagcatctcttcaaccgtatccagcgatggaaattccactttttcatctgacaggagctgaatattatgaaaactcttaacaaaaatcctctccgcactccgcagactgatttcttttgttttctgacagagatcttcaaattctttctcactgaaaatccatctggtgtgcatccatcttctgttcagttcttcaactttttcctgattttcctcttctgcatgtccatctctgcatgtccgcatgtactttgcactgacccgttccagtatcgttccacactcttccggggaaaaactgatctttgagatatagtctaacgcacccatacggattgccgtctgtgcataactgaaattctcatatacagaaagaattacaaatttaatttccggaaattcctctccgcacatctgcataagttccagtccatcaatttccggcatatctatatcggtaaatacaatatccaccggatgatttcggataaattcaagggcttttctcccattctgtacatctcccactacctcgaatccatactttttccagtccataatagcaaccagaccttttctagcaagtttgtcgtcatctacaatcaatacgttcatctgtctgtcccaccttattttcttccaatgtaacctctttgtctttctcttttttttcttccggttcccggacaggaagaaggatcgtaattttggttccgaacccttttttgctgtttacaaacaaactcgtctgtccatcataaaatgattccagcatagccttgacgtagcgcagtccgatacctctgttctcattcttccagtatccccagtcataatcaaacggctggttgatctcatcaatctcctcctgattcagtccctttccgctgtcagagatagttacaacagcaaaatgccttgccacatcttcaaacacctggatgctgatcttctcatcatccccaagaccatagcggatcgcgttctccacaagtggctgaaaaagcatacggaccgttggctggtcaagataactgccatcttctatattcatctcaataataaaatcataccgcatctgctgaagtgcaatatattcctttacaatctccaactccatccgcaacgttgtctggcggccttctttgcccagattataggaaagaagcttctttagtctctgtacaaactcactgatctctctttggtgactcatttgtgccatccactgaatcgaattcagtgtattgagaaggaaatgaggattaatttgatagagaagtttctcaaactctatcttctgtatgcttttttccttttctaccatattgctgataagattctcaatctgtctcttcatctgttctacttccctcatcaggctgtcaaactctgcaatgtccgactcttcatgtactgcctgaagagcgccatccccaatctgcaccatctgtctgcggaattgactcagtggtcggcagatcatacgataaagatagaggacagacatggaaaagatcagaaacgttacaactatgatgagtgtcatcttcattctccactggttactcttcttgtgatatatattgtccggcagtgccactgcattaatgtatcccatctgactccggtatgccatgatcttatagccctctctcgtctggacttcatactccccctttgagagtgatgcagaaaacagtttctgtccctgtataatgacaggatttacgctgtattgtgcaacccctctctcatccgtctgaatataagtgtagggatatccttccttatttatttcttccggggtcttcatatcagcctctatttctgtgtaaatttccagttttttcccattgcccaaaactccttccctcatgacggaaaaaactgttttctcactactcccaagaaaagacgcatgggctgcctgcataacatttcccgcacacttcacaaccttaggcaatgcgttctgtcttccgtccagtgttctgacattcataccgctgataagttcctttttctcttccttgtcataataggtagcgcctaccagttttgtgttgacatatcctaatcccaaaagttcttgtctaagggatctctgttcaacaaacctgtcaaaattatccacagcatcaagataactgtccgttacgtttccgatcagaccgcccggtcccatatagtttacaatactgatcatatcataataggcttcatccgtattcttcgtaatctgatccagatacattttcatgttatcctctatactgtcattctgtatcattctcagttccatataggatacaattaccgcagccagaaggcttgtcatcgcacacatcgtcaatatgccaagcatttttgccttcaatgttttcttcttttttttccgagctatccccatatacctgtttctctcctcaactgcatcactaaaaaagactgcgcatcggcaatatcccgccaacgcgcagtctgtattctctgtatacaaaactcctgacaaacgcctgtcatcagatatccgtgacaattgtcgaattttatatagtatatcacacggtctgaataatgtaaagcagttgtccttctgacagcagtagaaggagaactagcatgagcaaatatattcccggtaatcaaaaacatcttactctcgaagatcgcaaatacaaagaatgtctttcacagtccagggccggtataaacatgaccagacacgaactgcatcaggaagatatggtcatcacgcccctgatttttcagggccagtctccatatctgcctcttctccacagtatggacataccaatgttggtgcaatttttaaatccagaaacctgcttccacactctttacactcataataaccgcactgctctgtgccatccggtacataatacatatataatttcctgcctttcattttttagtgttatttccatgtcttccatacatccggccggtacccgattgttgactgcctgccgtttctaaccaccggtgtcttaatcacctgcggattttcaagcactttatccagcttgtcctcatctgctatgtactttataagtgccagcaaatccttatctttgccatcccagttaatcatattgtcaagaccgccattcacctgggcgacagaattaaattcgcccttgctcatgcctttttccttcatatcgataaactgaaactttatcccacgctccttgaaaaataacatcattatgatattcaataaattctttttctggtaaaaacttatctggcaatactatttctttaccattatagtaattaaaccattgcttggatttaggtttcctcccttaatgcacccttgaaaagtaatccatcaatattcctttgatatgattatatcttctcgcatatgagttttccacccggataatttccatgttgtgtgccttgcatatcgcatttttctttctgtcccgctctttcaccaccgcatcctcaaagtgttctttaccatctaattctatggcaagtattggcaattcgcttctgccttgtttttcgtatacaacaaaatcaaaacgtcccatgtaaaacaagtcatcataggttatgttatctctgaatacctgtgatatggcaacctccttgtgtattacatatttactctgcgaaagccagatattttcaagagcatgggttagattttcaagaaacgcattttctgtagccgtcgagaacggctgtattcccagtgctcgtgagcttatatgcttttcagtaatttttgagtggccattggtctttacatactgcgccagctcatacaaatcatcatctgcttgtcccgcatgcagtctttccagttcttttccgtttgtgagaagtaccagcttctcctttgctctggatgtcgcaacatttatgagttccttattatttttaagccagttatatgtacctgagcttgtcctttcagagattgctgtagaaaacagcactacatccttctcatcgccctgaaatgcatgaaccgttccacaaacaagattgctcagcttattctgctttattgcattttcaatcaattgcttttgattgacaaacggcgtaataacagcaatgcttttatccttatttaaaagcgcatattccaccacttcctcaacctcagccggcgaagtattttttatctgtgtgttatcgcttttcacatccatatagacaagcggttcaggctcattactctttgactgtatcttgagctttgagttatagtattttttattgttaaaacctattatttctttattgcatctgtagtgatttctcagaagcacctcatcacttactgcatcacaggcaagatacgttttatagattgaattttccctataatcgtactcatctgatacatgatacctgcgacgaagctttttgtttgtcagttctccaagcaggataaccggatttagttgttgcggatctcccaccagcatcagtttttctcctctgattataggcacaagtgagattgccacattacactgacttgcctcatccataattgtcatatcaaataaaggctcaggctcacctattttgtgcgcagaaatgcatgtcgttatgattataggaaaaactcgctgaagctttcttacattttcagacttgctcatatatttgttaaactcattcaccagcttctctggtgtctcatcagaatccagtatctgtctaagctcctggaatttaggttcctcgagtgcctttatatagcgtgcagatgtgtaaaacagatactgataaaattcatcctcgtttctatccagaagctgcattgcatcagcatcagatatctcaccgatagcagctatccttttatcaagcttctgcatctgatagccttgcagatctgtctgaaacggcaatagcttcatagtatttttcatatgttcctgatatttcatcagatgtgtaagtgtctcttttctctcctttaaatccagaatttcctcatattcctttagacgtgcagacaaacgctttgccctgtctatacgatcatccttccgcttatcaagtgtagaggcaaaaatctgcaatgactgcacctgtgtacgcagctcattaatatatttaattgcctccattactttttctgtattccccaggcgaagcactggaaatgggattgtcttcccacgatacttcatggatgagagcttttcaaaaacattatctatcgggacattattatatgatgcaaacagcactgtgacattgttaaaaaatgctgttactatcgtgtttattatagtatttgttttgcctgtgccaggtggtccctgaatatatgcaagaggatatttcatagcattgtttatcgcaagcagctgatccagatttatatttttattaatcagtgcaatcggatatgccttcgtccttcttggtctctcaagaagctctccaaaaaaagcctttattggatatgtcacattatcagcctcaaacatatccataattgccttatattcttcgtgcagattgagaaccacgtccatgccaagtccaataacatacggcatatcatctactatggatttgttgccaccatgctcagttattgcatcctttattttttccagatttttctcaaaatcctccaaaagctcatattcatcggcatctaaaaatttccttgcattttcctgttttccatctatagaaaactgcgtacacactgtaatctcctcatccggtttaaaaatatgattttttacatcaagatttagatttctatatgcaagaacatagagtcctttattagtgtttatactcaggacatttattgccagcctcttaacttttaatgatccgctttttcttttttcccgcgatgaaaaatactgaaattgagcaaccacttccctgaactgctggtctgtaagctgatacataccacagttaatcctatctctatcaatgtaatgaatcaaatcgtaatctgtgatatacggagtcgtatcaagcttattacatatctcaagataatttagtatttttaaatttgctgagctgtcaaatatatttttgtaacgctctggatgcatctcaatatcttcaacaagtatcttgttttcagggcagtatgtcccctctattatctcagtagacaatattgaatcgataaatatcctgtcatattctccaatcgtaagctgtcccagatgaagtccatcaaccttcatagttcggcttctcggatcaaggtctcttatccctatccaatatttcgtcacctgatctgccttgtttcgatattctattttcagccatttaccctcatgtatggctctgaaaatatccctgcaaatttggttcatactgcctcccacagctcattccatccggcatagcaaaacttcttatacatgtcaagataggtctaacaaatttttttgccatttttttcgatggcagaaaatcagtacctttctactctaatatttcatctaacaattcaacatacacagtctactatttactgacatatattattttcgctccacatacctcaactctatatcataccccagcgcttccatcatcttaacaaaggtctgattcaccacaccatcctgcttcttgatcacacgattcacataagccttcgtggtttctatctcctctgccagatttacctgggtcttaccttgctctatgcactttgtttttacgtctaattcaatattgttcttaaccatatctgatacctcaaacggaaaccaaaagttatcttttccgtataatttatagtacaccaaatctcgtaaattttcaatcctgcccacataagaaaaaccggtcagcctcatcatccaaccggctttaccgctgttggctttggctttcttcctgccataacctcctttccaaattttctgtataataaaaggacctgcgaaaaggtcctctaaaaatttttatgtaagtttgctgcttaattcagccaatttctgttttatgcttatattgtatttcgtcgccaaatccttaatccattgtctctcttcttcacgataaggttccttaaaaaaccttttaatgaattttgaaatttgactcctgaacgaccaatttagttgtgattggttattcaccagttcaaaatcttccacagtttgctctgcatcaacaatacccattaagtatctcaaaataagcacatctgcaaaagtaaaaggcattatatcataatctaattgaagtaatgacatatatggtccaccttgctttgtatcatctgtgaccaatgaatatgcgcctatagtttgtgccaaagaaatcgcatacacttctcctagatcacccgcattatataatattcggttttcccgcacattattttcaaacatcttataaaccgctaaatccttaagcttttgatccgtaaaaagttctattttaccagcgttaatatccgaatctacttttgtaaggatgtcctgcccatgatgttcaagttccatcgaacgaatctgctcatagataaaaacaccttcatcaaatagatcaaataaaattccttgaagttcggctctatatagatgaatgattacatttgtatctaatgaggctctcaatcttccaaacctcctatcaaatcattcaaatcatcctcttcatgtttcttttcaatcaatctatcgctaatatcgtccatgcttaattgatagcattctaacactttttcaagcgtctcaaccggaatagcatcatgattataattgtaaattacataatcaatgtactcaaaaggaatatctatctcttcgcttgcctggttaagtctcgcatttccgcccgcacttttcaacaaattaccaactctagttttattacgttggcaatccaatagagccttttgattaccagtaatttttccaaggctatcaagacgattcaatgccatgtcaaaactgacattaaattcagacataatttttgcgatatctatcgcagtcaatccgtttttctcaatatcagacaattctaaatcaaagaaacgatccacttcatcatctggcattaaaagacatgccgcaaaataatttgcttcctgctctcgctcatcggtacttctatctgcaatagtaatactatcatcaataaatgatgaatcagcttccatatgaaggactgcatgtccaagttcatgtgccaatgtaaaaatttctctcgacaaacgaatactagaatttgtgaaaataacaatatcctgatctttttttatagtaaatccaagatcagcgttttccccgagtggatatcgtataagcttatatcctaatcgagcacattccttaaataaatctataatgccgtatcgactaaccttacatttttcgcgtacaacggctgcagttcttcgaatatcctttcttctgctttcctgcataacatactcctcctttatctaatattattattttgaagcttgttatacatatgcttattggcataaaaaagatccagcatatcgaagatcttctctgaggaagactctgtaccaccagtgcgataagctacaaccggtgtttcatctagtactctagtgatgtcgccaactgtcacatctaaaatctctgcaactttagaaaggatatctaatgtaatactattagttccgctttcaacacgtgcatacttttgtctactcacaccgatttggtcagcaacctgttcctgtgttaaatttttagctattctcaaagccttaatacggcttcctaataattcattcatgattatccctccctttgtgcattaatcataacatataaatagcaaaagtcaagatgtgatgttacaaaattataacattatatattagaatgtcgcattttcattccttgtattttgagatcccccctactccatttcgcgattttgcacgcgtgcccccctcgttccccaggagcctatcctgtagagatttccacacccctaccgtcttgcatttgtatgttcaaattctcctaaatgtgttccacatgtcgcccgacttcaagagaatgaccgtagggcgaggtaaaggaaaacgaacgtccgcataacaaaaagtctttttctatgattgacggatgcatggttttttagtcacctttccatgctctttgctgtcctggatttaatacatcgcctctctaatgttctcaatcaatgtcacatccgccggtagccactttacgtccgccagatgctcccttgtaagccactttgcatcctccgcttcctttagtataagctcacctcgaatgacctcacaccagaagcaatccattgagagatggaaattaggataatcgtattctatcgtatctatcaattctccgatagcaatttccgtgtcaagctcctccattatctcgcgctttagcgcctgctgcggtgtctcaccagactcaatcttaccgcctggaaactcccagccgcccttgaactctccgtagcctctctgggttgcaaagataaccggtttattttcattattgactgctcttatgacggcagccactacgcgtattgttttcatattgccttaagctcctgtgtattattttgtatgctttgttgtaaattactctgcaaatatcgaagcagagcctctcttacagggtggcgcatcttcatttcaaacttggtgatatcgcgctctttgccattgttatcacgctttctggcagcgcgaacatcaactatatcaaactctcccatatagtagaaatttgactccgcatcactctttttcacaagcagatgctttcttttagtgttcaccacatctgacacatatgagctgtccacacccctgccaatctgcgaatcccacctgaaaatcatattgtcctcaaacgcatccgcgtaatccggctttccatctacatagtttttctgctcgtctgtgctttcctctttatgatacgtgacaaatataaatacatcatcatctatacgcttcattccatacattgtggaggaaagatccctaccacaattcatcagcagactgacatcacgcctggagtatttctcatacaatacaaacggactctcatttttaagtgaggattgatatttatcatgatatcttttgagtcccacctctattatgtcatctatctgctttttaaactcttcattttgaagtcttgtggtaaagttattcatcctatggaagatgttattgttatcctcctccaaaatatctatcctgcaaaatctcttgtactcatcatccttgctgacaaactttccctgcaatacatctgccgcattgtcaatggattgcatatttaccttgtaaccgtacctccgtatgaaaatctctcttatctcattaattgaaatagaaggcttcttcataagctgccttaaaatctctaattcaaacggtctcgcaccacttatgatagtcttcgacaaatactcaagagttgttttttcctgctcatttaatctgccgatataaagctccttctcaaccgcttcaagaaatgcctgatatgtcttgtactcttttattattacaagtgggtcaacctctccgttttcataaaaatccaatagatacggcactcttccaagccggtttttcaaagaaacatagctctccctgataatggatttcatgccctttattttgtctatcgacgcaaaaatcctatcctttgcaatctcatcaaaatgcactgtcgaagcgccgggaatcgtattatttccgctgataacatactttctgattgtatctgcattgtaagaacggtctcccgacaatgcgaccggtatcataaaattattgttatagttgccgatgaaatcaagtatcacaacatattccttgccatttgcttttctaagtccacgtccaagctgctgtataaatacaattggtgactctgtgggtctgagcatgatgacctggtttacttccacgatatcaacaccctcatttaaaatctcgacagaaaatatgtaatccagtggctgcatttttccatctgctttatctattttctctgttctttctgtgtcaaatatctgatctacattagtttcgttagtggtatctaacgtattttcatccatcgcaagccgctcgaaggctatctgtctctcctcctcggtggcatctccatttaatgcaattgtacggaaaaatcttcctgtctcaggatttatcgtctgattaaacttattcgataattcgactgattcgtctatcctgctgcaaaaaatcagccccttcaccctgtcgccgctatgtccaaaataattggcctgctcgatgatatgcttcaccctctcatcaccaacaagctggttgaacgatgcttctgtaagctttttgctctttatctccttgtcaccaagcaatgaaacatctgttattccaaagtagtggaacgggcacagcatgttttcctccatggcctgctgcaaacgaatctcatatgcaatctgataattaaaaatctggtaaatatttttttcttcaatatcatcatctcgcttatcaggagtcgctgtcattccaagccacagctttggtgtaaaatagttcattaccttttggtatgtgttggccgagctgtggtgtgcctcatccaaaattatacaatcaaaggcatccggttcatatttttgtagatgctcatcacgatttaaggtctgtactgttgcaaaaatataatccctgtcatagtcactgtgccctgcaccaacaagtcccatagaaactgatttatcaaaaatcttttcataggatttctttgtctgtcttgcaagctgacctctgtgtacgagaaacagtactcgcttgaaacccagctcacgcatggcaaacgcagatgcatatgtttttcctgtacccgtagccgagataaggagcgccctatcctcacccttttcaagtatttttctcagatttgtgataaagccaacctgcattgcattcggctttaatctgtatttttcaatagatggggtttcctcgctctttgcaatctcacgctgtctttttatgatttggtaacgctctttatattcctcataaaagctttcaaaggaaagcgcatagcgcgaattccaaagctcattatattcctcaacaatctgctttgccacctctccctgctctgtagatacaacctttgtattccactctctgttgctagtaagtgcggcgcttgtcatgtttgagcttccgataatgattcgataaatctcttcttttttgaatatatatccctttgtgtgaaagccttcagcggccttctccacatcatacattttgagcgtgatattcgacaatccatgaagcttctcaagcgcctttggttcactgaaattcagataatttgtagtgagaatttcccctgggataccattcttctccagctcctttagggtctgaagcaacggtgtaatgcctcccatcgtgataaacgcaacgcttatctgaaatttgtcacaggtcatcagctcatcttctattgaggataatacttttttaccctctttatggttatttgacaaaaattgcggctgataagccaggcttgaattgtatccactgttgatgaatccggtttccaaaccggcacgtagttctgctattttttgtatattcatactgcctcccaaagctcattccatccggcatatcccatcgacacaaaatatctaaaccatacgcgccatgcctcataaaacaagctgtctttgttctcctcagccaatgttaccaggtcagcacaccttactacatagtccttatcctttgtgaaacgacctgttaatatgccatttttgtatagctcatacagattttcaagggcagcctttgctattgccaggtcaaaattatcgactttgctttcgttgatttcattgaatttaaggcactccctatagtttttttctataacgttatctgatactttattttccatgttatcacattcatacctttaacaccatctcatgccactcttctccgccccaggtagagtccgcaatccccagatcctgcaatccaaacttcttatacatctccaccttctgctctaagcatgtcagaaacagcttttttcgtccgtttgccttttcacgccggctgtagcggtacacgagctctctggcaaggccctgtccacgatactccggcagcacgtcaaggcccagaagcatcacattcttaccgttttcatcacataaatcgatgtccgtaaagaactcatccctgaacttttcctcgtctgttgccacaccatttaaaaagcccgccagcttaccggttgatttgtcaatggccacgagaaatagctgtggtacctttgcaattctctctgtcattgcctttggagaacatgcctcattcggtgggaaacatatctgctcaattgctattgcctgttctacctcgtctgggtttatacttctaaattcaaaattatctgtcattattttatacctcattcttctgtttatcatatattaagatttttgtgttaccggccactctcaagcgtgaacagtaaaattttttgtatatgtatataatacgtgtttttgctgatataatcaataatcccccaaatacaaaaatcagtcacaaaagcattttactgcttttacgactgatttacattgcgacttcatttatgaatacctacaattaattatgaaagaacgataatgcttccttcaagccatcagactcatcattcatgtgtcctgccatttctgaaactccgtgcatcatcgcattgagctcctcgatgttggcattcatctcttcagttgctgcggcatttgctgcgctgacgtctgtcaggctgttgctgctcttcgtgatgtcatcgttcagctcaatcatcgcagtgacaagctcttcgatttcatcagctttttctgccgtcttttgaatctgctcatcaagtgagccaaattcatcgagtactgccttaatctcttccttctgcttggcattgtcctcgacgatggtgccggatgcctgtacacaatacctgcactcttcaaccagtgatgatattatctgcttgatattctcaagctccgtattggtattgtctgagagcactcgaatctcctgtgccactactgcgaagccttttcctgcatcgccggctctggccgcctctatagatgcattgagtgacaaaagattggtttcactggatatttcctcaatgacagagacaatattgctcaccttgtcaaccgtagtatttacagtttctatgcgttttgaaattgctgagataccctcatccatcttgtggctgctatcctgcatggatttaatcttgtcattcatgattttactgctatcctgcactgctaccgtctggtttttgatttcatcaacagaggcattaatgtcctttgtttcattgctcatttccagaagattttcattaatcttggaaatagatgctgccatgcctgtagagccctctgcaacatcctcgactgccttggatatctcgttatttgcagcaagtgtctgactgcttgtgtcattgagctcatagctgtttgatgacatcgtatcactggaatttcttatttttccgacaatacttccaagcgattgtgtgagctccttcatcttttctataatcaggcctatctcatcatttgactccttgaccacactgaaatctgcctcaatattaccattggcaacatcctcaattattgtactgacctttacaagcggtctcataagcctgcgtcccattatgaatgagataataattgcaataatcacaacaatagcaatgattccaacggcaactcctgttacagtagtgattcctgcaagtgcctcagattcatctgctgtaagcacaagtatattttcattgttcaaaatcgtatatgccgaatactttgttgttccattgaaatcatattctacaacagtcgtgcccggttttttgccatcctgaagctgttgtacaacgcctttaattacagcattctcaacaggctgtccaaccttttcctttgttggatgataaagcattgtgccatcattctttaccacatagacatatgagctgtccataccttcgagctttacatcggaaagactcttagcgtattcatcatagtctaaatcctctgtatctgcattgctgatctcattctccacaatttttgatgttgtattgataacatctaccatggtatgctttgtgctgtctgtaatttgttttttggagctttcaagaataaataccatacaaattacatttgaaactataacagctaaaatcaccattactatgattttggctgcaaatgtacctctttttttagttttactctgttccatatgaccatctctcctatcctactgctactgctactcctttagcttaaaattataagacaatattaccatttttggtgaaattatacaatagtttatcagtaaataaaaaatttatctacattttgcctttgattaatttgtcgcgcaaatagggttaatgttcaatcataaacagttatactacctattccacattctttaatgccatgtccatcggaatcctctttattctcctgaaatcaaatactgtcactatcaggtaaccgatgagcacaaacgcaaacatctttacatagccgacaggtgtcatatggaatgaaaaccatccgctgaaggtctgaagcattatgcgccatacaatgtccattacttttgcaccaagcactacgctgatgatatccgagatgactaccacgatggacgttgagaccagataaaggcttgcaatttctctgttgtcgtagcctaaaatcttggtcatcgatatggctgtctcatttttctcgatgatgagcttggtgagcagatatatcatgacggccgagagcagtatgcaaagcacctggaagtactgcatgtatgagcccatggagtggtcgagctggtccgccattttggtgatgtcgcgtatcgtgattgttgttgcgatattgctctcatcgatatcctttatctttgtgtctgacaaaaatccactgaatctgccatcagcaaaatcaaaggtatccgcgaaatgctctatcggcataaatactgcgatgctctgggatttatcgtaggttcccttcaccttgaatttgtatgtttttttctcgtactgtgcatcgagctttattgtatcgcccggttttataccatatttgtccgcaaaggaatctgatatgtatacctcgttatccttaagtgaatccatgtccttaagctttacgtaggcactatctttttctactccgtagacagacacctcctcgtcaaactcatctgtcctccttaagagcgatgtcatgtcaaatttctctgcgtcactgttgtcggtttcaagcacgtttccgtctgcatcgacatatgatttgagcacgtactggtatttggcaaacatcatgctgcctgtatttttcttgtaataatcaagtgtatccggcatgccgaccgccatagcaagcattaccatgatgaaaaatattcccacaaaaagtatcagatagtttgccacattctggaacatgattcgcagtctgaaacggctcatgaagctccatctcggaaggcgcattgcctttttgcgctttgttttcttaaggtcatgacgcaggaactgaagcggtgtgtgctgcatcatgcggattattacgataagatttacaaccagcattataattaccggagcaagtgtcgtttttacaaatgcgtccggattccagattgtatgatatgtaggcaggctgtagctgttgtaatacatgccgactaccacatccttgaataccgtatagcccagtatgttgcccgctaccgctgccagaaatgtcacaatgacaggcattgaaaggtagtgccgcaccagctcgccctttgtgtagcccgacgcgcgaagtgtgcctatcgctgatgactcatttgctatcgtattgctaatggtcactgcaaaaataaatgcgattatcacgataagaatgtctaaaagcactccacccatggctttgtctgagcccatatcgtccgtggcaaaattgattgcagggtttgcgtagcgtggtgtgtagtcctccacctcattgcctgctgccatcacttgtgacaccattgcctccaaaaagtcatctgatttttccttctgctctatgtcgtcagccggctcatcctcgtatttccatgcatatgtatagtgaatgctcttgtccaggcggtcaaagccctcctttgtcaccatcgccacgtcaaactttattgcatcaaacatcatatcggtcttcttttcatgcagtgtggagtaattgacatatgctataaggcccgataccttgaattcttttccgctgacctttattgtgtcaccgaccttcatgcccacgttgtctgcatgcattctgtccacggcgatttcgttctcattttgtggaaaagagccctcaatgagacatgcgaggttgatatcctcagtctttgtgtatacacggatggttccgtcctttttgccgtctgcgttgtagtcctcagtctcattgcgatagaaattctcgtagagcgtgaccggagttttgtcgctatcgctgtctttttcgtctgaagctgtttttacctcgcctgactcgatagccttaacgagctcgctgtcagccttatccctaagctcaaaatgtccatcctcctgcttgtacttactcactccctcatccgcagatgtgagcatactgttgtttgctacatacattccggatacaaagccgattgtcagcacaaggaatagaaatactacgagatatttcttccagtcgccgataatttccttcggtatgcgctttatcagaggattttttatctttttcctgctcataggtcaaaccctccttaccactcaagttcttcggccgaaaccttatttgtattgatatcgttgtggcgcacggctccgtctctgagctttatcacgtggtctgccatgtttttgatggcctcattgtgtgtgaccatgattatggtatttccgtactttttgttgacatcctctatgagcttcaaaatctcctttgaggtgttgtaatcaagcgctcctgtaggctcgtcgcagagcagtatatccggatttttcacgattgcacgccctattgacacacgctgctgctgtccgcctgataactggttcggaagcttgtaacggtgctcgtaaagccccagcgtgtgaagcagctcatcgatatccagtgcgttgtctgacaggtatgcgcccacctctatattttcctttacattcaggtttgcaatcaaattgtacatctgaaacacatatcccaggtgctttctgcggtactgtgtgagctttttctcgctcatatccttcagcttgtcgccatttatgctgatatatccggaatcggcgctgtcgatgccgccgatgatattgagcagtgtggactttccggagcccgacggtccgagcagcacacagaactcaccctttgccacggaaaaattcatgccgcgcagcacctcctggcgcgtctcgccgcttccgaaaccctttttcaaatccactatttctaagaactttctctcttcttctgacatatgatatcctctctttcaacatttagtgttattattaaagcttccctttgatatattcagggaagatattaacctatttgattatattttcgttgcctgattcactatgtgttgcctgattttctctgtgatagccgaattatacgtgtatcacttgtgttatatgtatgctacttaaattatatatgtattatctctattagttttatctaaccatgccggatttttttaggtcttccgccttttgtcatatatgcgaaagaccctgtctacttaatacccacaggctatgattttactatagcataccagcctgcaagcagatacttcattcctttttctgcaaaatccattgcttctttttcattatcaatatgtgtcaccataaaaataaacatatcaatctgtgaatgcgacatccagtgcactacctttttatcaaccattggcactccgtttgccctgcacatcgcctcgcataaaatggcattgtgttcatccatcatgtcaactatcctgtccgtcacatgctccattgtcgagccttgcgcaccggtaagcagcaacaatgtctcttctctgttctgataaagctcatgaactataagcttcatagcctcataatcacttgtgctgtcatgaaaatctccggctgttagttgcgattcctccagctcaaatgcatgatgctcctttatcatcgtattcagatgctcaagcagttctccaactacctcacaaaacaattcatccttatccttaaagaaaaaatacagtgcacctgttgtaacaccggcttttttacatatactgcgcaaagatgcctttgcaaagcctttgtctgtaaattctgccttcgcactgcttataagctgctttcttgtctcgctgctgtgcattttgtctgatgctgccattgtgccggactcccccctgatatgctgccttggatttatgttttagataacataacaacgttatcttggataacaccgttatgttactccatatttttgtttttgtcaaacactttttcatatttactgccaattgcctaattaacactatcctcttttgagcataatatagataaaatctattttacggagatatgaatttttatgtgtggtattgccggattctgcaattttaaagaaaactttgaagaaaacaccgattactggaactttcgtcttgagaagatgcgtgctgtgctcgcccaccgcggcaacgatgccagaggacgctaccttaaaaagcatattggtctgtcgcacagccgtctggccatccgtgatatcctgtgcggcgaccagcccatgacgcgcacccacaatggctatgattacacaatctgctataacggagaaatttacaacactgatgagctgattcccgagctgtccgaaaacggctttgtatgctccacaacctcagacaccgaggttattctgtatgcctacatccactggggcgctgattttgtcagccgcctaaacggcatttttgcatttgccatatgggatgctgctaaaaaccggctgcttttgtaccgcgaccgcgtgggtgtcaaaccgcttttttatgccatccgtggggattctctggtgtttggctccgagcctaaggcctgctttgcgcacccggcagtaaagcctgagcttgataagcagggcttgcaggagcttcttgctatcgggcctgcgcacacgagcgggctttccctgtttaaggatttgtttgaggttttgccgggtcacttcatgatttactcccgggatggactgcatgacgaaacctattgggagcttacgagccgggagcacaccgagagctaccgggataccgtttcccacacgcgctttctggtggaggatgctataaaaagacagatggtttccgatgtgccggtgtgtacttttctgtcaggcggcattgattcaagcatcgtgaccgccatcgccgcaaactatatgaacacacgcggtaaaacgctcaacacattttccttcgactttaaggacaatgacaggtattttaaggcaaacgccttccagccggagagggatctgccctatgtcaatcgaatgcttgaagagtatgagacagcccactcctatctcgagtgtgatgagaattctctcttcaaggcgctctttgccgcagtcgatgcaaaggatatgccaggaatgaccgatgtggattcgtcgcttttgtatttttgcagcctcgtcagccgcaaaaacaaggtggctcttaccggtgagtgtgctgatgaaatctttggcggatatccgtggttttaccgcaaagagctgcttgaaagatatggcttcccatggtcatcggatgttgctccgcgtcttgcccttttgcgcgatgatgtggccttggagcttgatttatcaggttatcaggcatttcgatatgaagagtcccggtcaaaagcccctcttctttacggtgaaaccggtgaggacgaaagccgccgcattataggctatctcaatatcaaatggttcatgcagacgcttcttgaccgaatggaccggaccagcatgtactctgagcttgaggcccgcgtgccatttgccgaccatcgtatcatcgaatacgtcttcaatgtgccgtggcatatgaaatatcaaaacggtgtggaaaagactctgcttcgcgatgctttttcagatgtcctgcctccggagcttctgcacagaaaaaagagcccatatccaaagacctatcatcccggatatgaagctctccttataaagggaatggaggagatattagactcccctaatgcccctgtgcgtgctctcattgacaccggcaaaacaagtgaattcttaaaagcacccgcagaatacggcaggccgtggtttggtcagctcatggcaggcccacagcttattgcatatttcatccagattaattactggatggagaaatatcagctgagtgtttagaagcgcagtaccatctgtaagtggcagcgtatagtcgctgtcatttacatttgcgactataaaaatgcccggcaatttatagccttagttaatcttgcgctctatatctatgatattattatctatgctcttgttatctatgatattgttatctatgctcttgttatctatgatattgttatctatgctctctgccgaagatgtgctgtcattattctgctctttcggtgtaaagcttctcaccttatccatgagccggctctttttcagctcatgcttaagctcaacacgctcactcttctgctgtcgttttttctccttcagctcgtactttgcctgtttctttgcgagcttattctgccttttctgttcctttatggcagcctttgtctctctctttgcctgctttgccgcaagctttgcctcttttgcttcactctttatgcggctctttttgtttttctttacgctctttttggctaccttatgtagttccttgaggtctgactttgcagcctttatattctttctatccttgcggtatggattgtgcacaaagtatcccacagtgcctatcatcataagaagcagtgccagtgcctctcccaccatcgtgacatactccagatactgcggatacagcttgtagcctatcatctccgctgctatcagtataagcgggatgaaaaacaatatattctttcgcttttgggacaatatcgctccctccgcgcctacacacatgagtatatacaggcacagctgtgaggttggtccgtaggcatatgccacaatcgcagccattatcacagatatgcaaaacacgatgaatgcttcgccacgaaacagggcattcttgtactcttttatgccctccagcttgtctaccgatatgccatgcagtgaatatacctgatctgtgatgtcctccatgcagtcctcatggtatcgcttcagctccctgttgctgtttatatcggcatctatggagcgtctgcgctctgtaagcagcttctgctcctccatgatcttctcccaggcctcgtcctccgcttcacgctgcagcttcacctgctcgtgaatccactcagctcgctggatgcgctcgctctcctgcgggataaccacctgctgcgcgtcaactgtctgctgtggtgtttgagtctcctgcgccatgctgttattttcattttcattatttatcattccggttttctgcctctttcttccagacattttcttttcctcttgcaattgttatttactgctatatatgtctattaaagcatattttagcggaattttccataggatatgctcctccttgtccatttttgatttttacgattacataatcttgaagttatagtgctatttttttccattttctaatcttagttctaaatgttccgaatggagcaactgtgttaacatgtatgaacttgtatacttcccagacggctgtcttagttgcttcgtcagcccattttctcatatgtggtttaaataattcttcctcacttagcgaatcgatcattgcataaatagaattaatattatcattcaacatatctttcaactcttcaaagcaacaatttatttcattccacttttctgtgcatccaaatacctgtgccggtattttagccctgcatactccgtgatccgtttcatgtaaatcgcatcatatgccccgccgactgctccgaccacaggaattccctgtaagaacttcatataaagcagctcttttgacaaagctcctgctgtttccccgatctgcttcttttcctgatactcttccggcaacgttccacaactgataaattcattcagtttgccatcaatctcacaaaacgtttccccataggataccgctccctgtatcaatagcaggataaaatacttttcttccctgctttcgtagctatatccataatgcagggcagtctcgtagatattcttcagtatcatccctgtaaataccggaatatccggcagaccaattcccagtactcccatcccaatcccggatgcgccggatagcagtaaattctttgttcctgtatctctcgcttttttagaaaaggctcgcagggatttggaatcctgctttacatccgccgtatactgtcgtacctgatagtcctgctccaacttctcccgttgatacgtcttttcaataactccggttcctttctcaaaaatcagagcaaacgctttggcaaaagcggcatcaagtgttccctgaagtttaggcggtatcttctcctccagcttttgattcaagatactttcctttttttccaaccgtttccgaaggaatctctgctcctgtacttccagcttatcccactctttctgaagcggcgtccttttatcaaatagtcgcattttaatacacctccccgttcatctgacgttttacatgatccagcaaacattggtccctgacaccattaaatttttataactaataaccatagctaatgcacttccaaaagttattcctgattttaccattttcttgacagtcgttgatttattatcttccatttttgttttctccgtatattcctattttcttaattctgcaagctggaattttcgcattatttctgttgtgccttaactaaaatgctttctgttacaagggctatcgttataagggctcctacaagggagtaattgtttaatccatacatcaacggcataagagaaataattgctgtaataatcgaaagaacaaacaaggcgttaaaaacgctatctttcttcaaagaaatcaacgaaagcaacaagataacaacagtaagtatggctgtaataagtggagtaaaatttgcatatccaaacggtataaggctaaagtatgaaaatgtttctcttactctttctgttggagatggagcaaaagtacaaactgctcccagtggtaatgcttctaacactattgttaaagccggaaaaaccactaagctgatttttttcatgttgtgtacctccgtctacaaatcagaattttccgaaacttactttatgctgttaaatactataaattcatcccacaattcatcataattatcaaattcataatatgtgtcctcaacttcaaaatattttcctggactaattgtcagcgtttcatctgttgcaaaatagattgtgtaataagaaacagctccacttgataatgctttgttttcatctactatgtcaccaagtttcacttgattcaataaatctataaactcaacaacttctttatctgaaaaaaaatacgaataattaccgtctttcccacctgtagttcctgtaagttcgatttgtttgatttccgacgcatcaatgctctccaagtccttattcacatcttgttttccgcatcctaacaatgtacctgtaagtgaaataagtatgagtaaaactattccaatttttttcatttacataaccctccatttacatttcagtttgacaacttctagctcgacaagctgatagttgttcaaataatatttctatgcaaatgaagcatagataacccatatttctgcaaacattaccaataaaagtacaccatctatcatccaattaaactggatgtccgttaagaaagtttttgaatgtgtcaggaaatattttactttttctcgtcctgtcaaaaatgtgataagcacttgtaatataggaaataagaatatttggatttttcttccataatcatccgcaatcccatttgcaaaatgtactggaataatactcggtaagaaaaatatgctcacaagagcaagcaaacatcctataatgcaaattatccatgtgaattttctggtattgataagcttcataacaatccttctttctgtcaaaattcaaatttattttacatctccaacttccgattatacaagctgagatttatctctcttttcgcttgtcctgctctaatgcaataaatccagcggtaacagcaagggcaagcataatatcatgttcgcctaatgggtctgttactatggaataaatcaaaaacaccgcacaaaccagcaatactgccaatataatcctacgaacaatttttcttttttccattgcataacgctcctttacaactttcgattttaatgtctctattataccataatgatactattatgaaaaatgaaaaaagagttcacccacgatatgggtgtcaatcagacaaagacactcctttacatagtttccactttcaaaaaataaaaaaatttgtgtttttgaaagtgacatcttgcatattctattagcaaacagtatactaagtacaacgaagcagtttcgagaaatgaaaaaaatccaatttttgaaagtgggtgactatatgaaaacaatcacgagaactaaatatctcgatagaatcattgaactgaatggcactcctgacatcaagatcatcacgggtattcgtcgttccggtaagtccaagcttatgcaggcgtatattgagtatctgaaaagcaactttgaaaacatcaatattatcttcattgacttcatggatttagcatatgaagaaatcaaggaataccatgccttacacgcatatgtggaagaacattatcaggaatgtaaaatgaactacctgtttgtagacgaggttcaaatgtgccctaagtttgagctggcaatcaatagcctgtactctaagggaaaatacgacatctatgtaacaggctccaacgctttcctgttgagtgcagatctggcaaccctgtttaccggacgctatattgaaagacgacatcttattatgcctcacatatttacagagcatatagtcatatctgtaataaatgtgccaacgaccgcacaggttgctatagaaaaactgctttgactatattttaacatatgtgaaagaaatagcaagcggtttgtattttattatattgtttttgttgtatatgcaacatatttttggacaaaattatagtaatattgtattataaataatgaaatcaacattcaagaaagaaggacaagaaatcctatggacaaggttttcaaaatagaagatttacgccctatccgcgacaagatgaccgtctcacgaaattcaaggcttagtgacaaaacacccataacctatttttctctcggaaagggcacgtcaatctctcaggagtcctacgataataccactgtatacatcggtgcaaaaggatgcgctgattttcttatcggagcttatgctgcaaagcataccatatcagaaggtgatatgctggtagtcccttcgaaaacactctgcggagtaacaacagaaaccggctgtatttacaccgaaatcatcataaaaaaggagaacaacaatatgaacaaaattatcaaatcaggcgaggtcatgaagcttaaggatcttatctcatatgaggatggcagtatcacgaacattgatgtggtaagcaacgacacaatgaaattcgtgcttatggcattcgatgagggcaccggtctcacaccgcatcgcgcgcctggaaatgcaataattttcgcactcgagggcaaggctgtaatagactacgagggcaaagattacacaatctcagcaggcgaaaatttccgttttgacaaaaacggactgcacagcgtaaccgctgacgaaaggttcaagatgggacttcttctggtgttggagtaaagcacattaaaaagcacaaaaaatccgctatacccaatacaatggttagcggatttttgctatttacattttgataaattattcatgcctgatgctacacagtctccggcaccttatagcctgcttcattcattaatttttcaaactcactgacactgacaccggcttcctctgctgcagtatcaatatcgagcttgccctttgttaccagagtaaacaacatcttattctccccctgttgtattccaagctttttatgatcttcccatgccttacacacattaatcacctcttccttttcttcatactcaatatctgttcctgcaaacaaattcattgctgctattgtctcaacatcgacttttttaaaaatatcatctgtcgtgattaaatcatttagttttctttcatctgatgcattattctacacctgacatattattttcctgctatttactggtatcttaaagcatcgaaaatttccatgtcctttgtagaatgatgcgaagtggtctgccctcttcaaagtgatacgcaccaattattgacgtgttatgtggtgacgctctacagaaatataatgctttaactaaattgtaacatagggatattcttttgtcattatgaaaatcaatgtattttataatttatatatattatatttacacgcattgaatttatacgtatcatatgttatattatatattaaagaaaggtggataaaaatatgccgatcaaaccaactgaaatggaacgtataatacttgccgatgggtggattttcaaaaaccaaaccggatcacatcggcattatattcatccttcaaagcccggaaaagtaactattcctttttataaaggcaaagaactgaacaaaatcactgaaaattctatccgtatgcaagcgggaatcaaataatcataaggaggtatactcatcatgttatcaatatatccggcatgtttttttaaggaagataatggatactctgtaatctttcctgatttaaattatcttgcaacacaaggagatacccttgaagatgctgtggccatggctgttgattgtcttgcaggatatctgtatacggctaagatggataatgaaaaatttcctaaagcatccaaattatctgatatcaatattgacagactatctgacgaattagacataacaggaacatataccgatgcatttaccaatatggtttcagtagatgttaaggcatatgccaaagagcatttcgataaatcggtccgaaaaacccttaccattccggcttggctaaatactgctgcgcaggaagagggaattaatttttcaaaaacactgcaggaagcacttatgtcaaagcttaaggctcattagatatctgcattataattcggagacattatgaacaacgatataaaatacaagctggccaatgccatgaaggaatgcatgttttcctctcctgtcgagaaaattacggttaaggaaatctgcgacacatgtggtgtgaccagacaaaccttttacagaaattttcaggacaaatatgacctgataaactggtattttgataagatactgattgaatccttccaccagatgggtgagggcagtaccgtgtacgaaagccttgttaaaaaatttgaatatatccggatggagcaccttttctttaaggctgcttttaaaaatgatgagcagaacaatctaaaggagcatgattttgagctgattcgtcagttttatattgaccagatcgaaggaaaaagccaccggaaaatatccgacaagctattgttccagcttgagatgtactgtcagggctctgtctttatgacaacacagtgggtgcttggcaataaaaacttcacccctcaggagcttgccggactgctcgctgatgctatgccaaaggagcttgccgacgtgtttcgcgaggtaaacctgatataattcaaggtaatattcaaaaccatttagaacaggtatcgtgcatttttacaaatgtgcacggtggtcagaatagttatatcagcgttaaaaatccgggaatgctgtcaattgacagttcccggattttctattttatttcattcttaatcgtaactattcacaaacatccctgtaagctgttgcagaattacataatcttacggaaaagagccttcaaatcctcaacacttgcatcctttggatttccaggtgcacatgcatccgcgtgagcagactctgcgaggaagtctaagtcatcctccttaatagcttcaagctttgttgggattcctacatctacagagagctgcgctacagcatcgattgcagcctttctgtactcctctacagacatatcatctactccctttactcccattgcgcgggcaatttcacgatatttttcgcctgtacagtctgcattgtactccattacgattggaagcatcatagcacatgctactccgtgtggtgtatcataaacagctccgagtgtatgggccattgaatgagcaattccaagtcctacatttgagaatcccattccggcaatatactctccaagtgccatgccctcacgtccctctttttcattggcaactgcacttcttaaggatcttgcaataatctctattgctttgagatggaacatgtctgtcatctcccaggcagcctttgttgtgtagccctcgatagcatgtgtgagtgcgtccatacctgttgatgctgtaagtccctttggcattgatgacatcatgtctgggtctacgattgcgatgattggcatgtcatgtgggtccacacatacaaactttctctttctctctacatctgtgatgacatagttgattgtaacctctgctgctgttcctgctgttgtaggtactgcgatgataggaacacaaggcttctttgtaggtgcaacaccctctaagcttcttacatcctcaaactccgggtttgcgatgatgataccgattgcctttgatgtatccatagaagatccgcctccgattgcaatgaggtaatcagctcctgatttcttaaatgtctctacgccatgctttacgttgtcgattgttggatttggcttaatctctgagtaaagctcatattccaatccgttcttatcaaggatatctgttacctttgctgtaactccaaatttgattaagtcagggtcagagcataccagtgcttttttaaagccatgcgcttttgcctctgttgcaatctcctggattgcacctgatccgtgataagatgtctcgtttaacatgattctgttagccatagtgtaaaatctccttccaattttaaaaaaatactcctaaaaaactctgccgataaattcttataacttatctgcctgactatattttaacaaagtattaaacgagatgtaagttacaaacctgccaatgtgtaacatacctgttgcaatatgtaacctgccagttacctatgtatatcccaccgactgccaatcacaccttatggctgtctgatataactttctttaactctcttgccgccgcactaatcggttgatgtatatcatataccatacatatatttctctgcggtatctcctcctccagagctatctctacaatctcgcgatttgctatcgcagcctctgccataggctttggcataaaggcaagaccaagctcacttttcacaagtggcagtatctgatctgtcgttgcggtctctgtatcaggcgcaaattcaagtccgtgtgacataaaaagcctgttaaaaaactgaaatgtcatggtctcccgccccagtccgataagaggataattatgcagctcctttaatgacagagtctggcttccgagcgcagtaaaggtggttccacccacaagaatctcctgaaacgaaccaagctttatcatcttaagaggggcctccacctcagccggtgtcgataccactgcaaaatcaatcatgccgttttttacggcatttatagcctgtggggtggagtgattatatatcttaagcctgatacccggatatgccatgtgaaaaggttttagccggtcaagcagatatatgtttagagctgtctcactggctcctattgatacgcttccgtgtgacagtcctgtgctgtctgacagctcctcctccgcagcaagtatctgtgacatcgctgcagatacatgcgcgtacagacgctctccctccggtgtgagctgcacacctctgttatttctgataaaaagtatgctgtttatctgctgctctaaattgttcatggcgcgggttacattcggctggctgtttccgagcgccctcgcagcctttgtgaaattgcagtattttgcaacataataaaatatcttgtagtactcaaaatttatatccatattcaaagcctcctttttattatcgttttaccggtcatttttccgataatacacagatactaatgatataataatatgatatttcaattatatcaattatactttttacttattataatcataattgtataatcataaatgctcaaaagagaaatattgattatatatataagaaaaggacgtgtttcaaatgagtgaaaagacaatgtttccaagagaagaccatacagaaatgctgtttcagaagatactaaacgatccatgggcgtgtgacaggcttatggaaaccttcaatgaaaatctggtttacaacgatgaatttgatgtatcacttccggcagaaaaatttgccaaagctctcttcaatgcatataccaaccgcgatctttccgcactgcttatgtgtctgtgcaacaacaccgtatttgatttgctgcgcaattcatatatcataccgtacaggttcaatgccgacggacatcaaaatccgataatcatgaccgatgagcacggaaatccgctgcccgagtataaacacatatctcacgacaagaactatatacattttcacgaaatatacaacgatatgccagacaaaaaggatatctactacgcacaggcttaccgctacagtcacacatatgattccgagcatatgactcccacgcagcaggtcattgtaaagcatgacggaatactcttgatacgagagcttcccgataccgtaaaactcaaggagactgaggctgaggcttactctgccgtatgggatctgatgatacagattgaaaaggagcttcctatggcatatgttttttacggtcaggactctcttgtggaaaatgacaagcggtatgatgaaattggtattttcctgcgaagctctcatttcctaaaaaatcttgaaaaacatgtacaaaaggccgaggcgataatttatggcagataacagctacacagatatcatggaaaaaaatcatatggaaatcccctggcatgattatgccagacaggatggaaatatactcatagataaggcaggactgattgaaaaagcctctgtaatcggacgtgtcggactcatcatgctctcctgcggcaccggagcctggcgtgtgagaacctccatgaaccggctctcaaaggagcttggtgtcacatgtacagtggatgtcggacttatgtcaatcgagtttaactgctttgacggaaatgactgtatatcacagtcactcagcatagcaaacacaggtgtaaacacatcaaagctctatcgcatggagcagtttgtcgacaattttcctaaggaggaagcgcacctgaccggcgaagaaatccaccggcgacttgatgagattgaacagattcatgccatttactcccctgcaaggcttggacttgcagcagctatagcatgctgtgccttcacatttttgctcggaggaggtcctattgaaatgatactggcatttgtagcagccggcatcggaaatctcatacgtacaaagcttataaaacatcattttactttgttcctaaatatagcggtatcaatttctgcttcatgcttcatatatgcggcatttttaaaaattgcagagatggctttcaatgtaccatcaattcacgaagccggatacatctgttctatgctctttatcatacccggatttccgtttatcacaagcggaatcgacctggcaaagctggatctacgctccggtcttgaacgccttgcctatgcaataataatagtcatggtagccacgatgtttgcatggattatggcactgcttctgcgactgcagcctatggactttgaagacttgaatctgacccccgtactacatctaatcctgaggcttataatgagcttcttcggtgtgtttggattctcaatcatgttcaacagtccagctcccatggctgcaacagccgcacttatcggtgccatagcaaattcactgcggcttgagctggtagacctgacaggtatgccggctcctgctgccgcatttgccggagctctcacagcagggcttctcgcatcatttatcaaggaaaacaacggatatccgagaatatcccttactgttccatccatagtcataatggttccgggactttatctgtatcgggctatatacaatttcggcataatggcactttcggatgctgtttcatggtttgcatcagcaatcatgattatcattgcactgccgctcggactcatctttgcaagaatactaactgataagacgtttaggtattgcacgtaacagaatcatacacattataagcagacttgttttataccattcaaaatccggacagtacaagttctgcaccaacatacaaatattaaactcaaaaaacaaggaggcattcatcatgcttacagcagttacaggaataaactggggagacgaaggaaagggtcgtgtcatcgaccttctcgcagaacatgcggatatcgtagtccgctatcagggtggtaacaatgccgtacacacagtagttaataaacagggaaaatttgtcttaaatctacttccatccggaatacttcacccagatgtagtatgtgtgctcggtgacggaatggttattgacctaaaccatctgtccaatgaaattgcacagatcagaacacaagatgtatctgtttcaccaaaaaacctgaaattatcaacaagagccacaatttcaatgccgtggcataaaatacaggatgagcttgaggaagagcgcctttcaaagtccggagcagccttcggctctaccaaacgcggtattgcctatgcatacagcgataaataccgtaaaaaaacaatccgtctcggtgatttactccacttagacgaagaaaatgtacaggccagacttaagaccatgcttgaagctaaaaaccttgagcttgcaggctgctatcatcaggagcctatgtctctgtcagctcttttgtcatggtgcaggcagaaggctgcaaaatatgcaccttatatcacagataccggtgcattccttgaggatgcactatcaaaaggaaaacgtgttgtacttgaagcacagcttggtgcaatgagggatatagactatggtattttcccatatacttcaagctcctccaccatctcagcttacggtcctataggtgccggtatccccggtgcctcattagaccatgtggtcggtgtactaaaggcatactctacctgtgtcggagccggaccatttgtcgcagaaaaagctatgaacggtgaatggactgaaatggtccgaaagtatgggggcgaatatggtgctgccactggaagaccacgtcgtgtgggtccgtttgatgccgttgcaagccgctatggtctaaaatgccagcatgctgacaaaatcgcactgaccaagctagatgtcctgagcatcatggatcagattcctgttatcacaggatatcagtataaaaatgccgtaacaaacgtctttgaccctaccgaaaatctcgaaaaatataccccggtagtcaaaatgctgccggggtggaaaaccgatatatcaaattgcaggtcatatgatgagctgcctgtaaatgctaagcgctacataaacttccttgaggacatgctaagacacgaaatacaatttgtctcagtcggagctgagagaaatcaatatcttctcaatggtaagtggctgtagttgcctttaacatgctttaaccgacctctatgccattgccatattatttttctgatttactaagatattgtatacacgaatgtgctgccacatttccttctccgacagccttcgtgtactggtatggcctgcctgtgcagtctcctgctgcaaaacagcctgccacatttgtctgttgggctctatccaccaatatatgtccgttttctatttcaagctggggcataagctttgatggtgcgatggcgttcctgaggcagaatactccgtctacgctctcagtctttccgcttcgaagcgtaattccttccacaaatgagtctccgattaatgctataggtgcatcctttgatatctttacatttggaagctctatttcgctgtcattataggttgggaaatacaatacctctgctgcaagatccgcaagatattttacctcatgctcatactttttgtcattgcatatgacagctatccttttatccttgtaaaacataccatcacaggtggcacagtagctgagcctctttccaagcagctcatcctccctgtccagctgctttgcagacattacacccatgcaaagtatgagagtccttgcctcatacatctcattgtctgcaagcaccataaagccgtttcctgcaggcatgatattggtcacagtcttttctgttatatcaattcccgcagctctcctatgagcgtcaaagcgttcaaacagctcctgtccgcttatctgtggaaatccgggatagtttgtgattttctctgccttttgcaccttttcgcttaggttcttcgaaccaaaccagataaaatcctttttatatgtttttaaattcagggctgccgacagtccggcaggacctgttcctattattatactatcgtacatgctatactccttgtaccaaatgtttgtatatatttagaccttatatagtgtgtggcactaaggtatacatcgaattgcatgcaagcatgcatcgatgatacggccatttaatcatattatgttattgtaacgtcacatacagtgcgccttcaatgcttcgatatactcccttgcatatcgcgagagtaccacaccctttctgctgataatgcctatcctcatatactcctccacatcaagtggctttgatataatattccttccattcagctcagcggaaatcactcctgagcacactgtgtagccatttaagccaattatcagattaaaaagtgtagctctgtctcttaccctgatattctttctgctgtcaagagtgctgacaaactcctccgaaaagtactgtgaattgtactctccctgctcatacgtcaggtacggatagtcctgcagatcatccatcgtgatgctcttttttgaagcaagcgggtgactgtcacatatgaatacatgcggtgtggctgtaaaaagctctgtgaactcgagttcattacgctttagcatctttgaaagcacctccgtattcttggagcttagatatatgactcccagctcactctttaaattcgtgacatcctcaataatttcgtgagtctgctcctccctgatggtaaaatcatactgatatgcatcaaacactctgattacatccacaaatgcattcaccgcaaaggaataatgctgacacgataccgcaaagtgcggcttactcaccacatcatccttgtagatcccctctatgagatctacctgctcgagcacctgtctggcatgaccgagaaatctctcaccatcttctgatagaatcacgcccttgtttgtcctgatgaaaataactatctgcatctctttttccagatcatgtatagcgctggtcacagtgggctgcgagacaaaaagctgcttggcagcctctgttatattgccgcattctgccactgtcaccacgtattttaattgttgcagagtcatgctcattctccttttgttacatatcgaaatattattttacatattttaaatgtcttacatcgcttaagtcatctcgaaactattactgtataccgataatctttctcagtatctcacccaacagctttccgagcataagcggaatgacaacaagcaccacataccacagcagcttgtcataccacaccctgccatcatttatcacacagataaagtgcatggcaacaactgccactgaaaatacagatgcaagaagctgcaaaaagctcgccacatgaagcttatttgttaccttgccaagcgtaaataaaagcatcgcaccaaagaacatcgctatatctgcctcccacggtatcattttactatacgaaaacagcttaaacatatcacgatactccatatgcagctcaagaaacaaatccactgatgctatcatgagcaatactgctcctattgtcgaaaataccgctgccagatatacataattgtttccaatcctgtgctgtctgagcttatatttaagcataccctttttctgcacatactgtgtacgcagataagaatctgtcgcagaggcaatagccctgtcgcagtactcggttgctgtcctgtatactttagctccggcatcgttatttttaagggcaaactccacaaggctctctcctgccctgttgttgccacgctccgtcgcagtaaccagataccctacaccaagcttctgctccttgccatcaaaaaaggtagtgaccagatactgaccataatcggcaagtgcatccacatttccaagctccactgctttcttccaccaaaacactgcgcgcccgggatcccggtatgtgccctgacctctttcaaacatatttgcagccatattcatggcatctgcatcgccagtctctgccagtggcagaaattgacggaatgctccctccatatcattttgtctgtatgccatcatagccatatcaaacgctgtacttttcatattgttctccttgacagccttagctgttttcttcttattataatgtatttaacatgatgatagcaatacgacttctttcccaatttatagcaaaatgccgcacccgaaggtgcggcatctaagaggtttataaaatgtttagtttaaaagctgttttatttgcaagctcttttcttgcgatatgtagctgctgtgattgctaccattgcgagtccaagtaagcatacatatgtagctgcttcattgtcatcgccactctttggagctgcttttttagtgtcattctgctgtttacctgcagttttcttatcaagagtaattgatgttgcagaaaccttttccggtgttggatctgtcttgccagaatctactgttttcttcacctcagcaagaataactgttccaccatcctttgctgccggaattgtaacagcaactgttttatcacttcctacagtatatgtagcaccgctgtataaatcctttacctctgttcctgctgctaagctaaccggaacttttacttcttttacggtatccttgatattcataccaacatataaggttgttcctccataggatcttgaaactacatcatagccttcctcatcagaacttgccacaactgttctgcttcctcttgcaaatacatctgtgtaagcattacggatgctcagcagattcttataatgctgatatgtgacattgtcctttgttgccttagagaaatccatgtcatatctattagtctgatatggataattatttaatccgcttaaaccaacttcttcaccataatagataaccggaataccctttgcagtaagctgtaaggtagctgcaactaacgctgctgatgttgcctcatcctcggtatatttttttccgttcattaaggaagccttaaatccatcttcatcatgactgcttaagaactgacccgtcatgtatgcgttattaagtgctgaatttcttgcagaaaggaatttctctacagaagaaatattgctacttacaaagcttgttgcctgatcgttaaaatcgaaatcaaggtctgcatccatctgaccactacctaaggtactaccatttgacgcatatcctgcaccataatattctccaatcatcttgaaagacggatttacttctgttgtagaatttttaagtgctgcccatgttgtactgtcaacatgctttactgtatctacacggaaatagtcaacaccataatccttcatccacgatgtctgccattctactaattttgccctgacctctgccttttctgttgcaaaatccggcaagccagactgccatgatttaatatcgccttcactgacgctcttatccctaagcatatcagcaaatgttgattctgtaccatatcctgcatgatttacaacaatatcaaccataatacgcataccacgtttatgtgcttcgctaatcatagttttaaattcttctgttgtacccattgtaggattcaattttgtaaaatcacttgcccagtatccatggtatgctgcattataaggaacatcttctgaaccctcatctgtcacagttacacctgcaatattctttacaattggtgtaagccagattgtatttactcctaaatcctgtaagtaatctaacttagctgttacacctgcaaaatctccgccatgatacagtccagggttgtctccgtatgtatctgtaccacttgctgtattgttagattcattaccatcaaagaatcggtctgtcatcataaagtagacaacagcttcatcccagtcgaaatcattttcatttttcttcacacggtctgtaatttcaacatcaactgtagtactgaatttattaccatactggtctgttacagtaattggtaatgtcttaattcctaatgctgtatctgttgttgcagaaatggtaactgcctgcagttccggctcaatcggcatctcactacttccaccaagtgaagaaacatcgatacttgcacttgcaacttcaagtttctgagtatctgtatcagcctgtttaacattaaacttaactacattattctcattgtagttaaatgacttattcataacttctgctgtaactgttgcatttaatttatagtattcaaaatatgagtaatctgcattattatacttttcgctgtttgaattgaatgcatctacaacataatttccatttgctttgtaacgataatgtgttttgccatttgttaaaccattctttacatactcaaaacgctttgttgtatcattgtatgtcattggatactctgttccgtttacgtcaacagatactttcatatcctttaaagtgccatctacaaatgcatcatcatcacgatagtagtatgatacctgttgattttctgcatctacttcatagccagtgttatatggcatagcaatttccggctcactgccggctttcatgctggcatagataaccttctgatcagaagggaatgtaactgaatggtctccaccatctttaatccatgggtcacctgttgaatctaatgcaatacaaaaatcaacctttgtgcaagatggttttgctgggattgttactgtccatttatctccacctacatatgtaaaatcggttaatactgaagcatatcctgatgaccatgtataaaactgtggtgtaatacctttttcttttaatcccggattctcataatccaatacaaggtatctcttttccgttggtacgattaccggtttctcatgaaccggatcggaaccatccacataatataatacctcattctcatcaccgcttattgtaaaagaacgatctgcagtatcagagccgccatcccatccttttgtattatcatagcgtgcctttaatcctaccgtttttcctacattactgccggcaactgtaatggtctgtttaaaccatgtcacattattttcagcatcataatatgttccgtcaaaaacataagaaccatttaatccggcattccacatccacaaatcaacttttcccatgtctttgtctgttgataagtcttcattgtaataataaattgtaaatgtgtggtccgcaaccggtgcctcccaactgtccggtgctgttttatatacggttgtatcaccttttgttccggtaacccagagctcagtacttgttgatgtcacagaaacatcaatattatccgtctgtgttccgttgttattattaaaaatacagctgaaattctgttttacatcctgtgtatatactacatcataccatcccaaatgatcagcatttgccgaaatctgtccgcccggccattcttttccaacacctgctcctgttgcagaggcatctgctccccacatataattgtaaatagtacttcccattcctgaagcaagataatggatggttgttacatatttccaatcggcaggttttgtctctgacaaagaaccatcgaaccagtactctgcttctgcctttccttttgtagaaagtgttacgtcgcttaactggtttccatgtccatcatcatttaagataagattataatctgtactgttatctaatgtcagatgcattgtataccagccttcatgtcctgctgttgcagtcatggtttttcccggccattcacctgccggcttattagtctccttatatatatatgctgcaacatcatcgcctaatgtgctcttataattaatagtcagatcacattctgttggtacagactccggaatcaaagtttccttctttgaagcatccttataccactgatattttccattgtcatccaataaacaataaatgcttgtatcagaagtaaaagtcttaatctgctcgattgcagctccttctgtctttatctccggtgcagactcatctttagaacctgcatcaacaaactgaaaacctgtccactcactgctctgtacatctacataatagagtccagaactttcctcatatgcaagctttggtttttcctgattcccccattgtgaaatggtggcatttcctgcgccatggttatctaccgcagcaccggcagcccagacatggacaaccggagtattccatgtacttggtttgtccaaatacaaccggattgtcgggctcgcagcatatgcagtggttgcaccaccgattgctggaaccatggtcataatcatagcaagcgcaagtaccatactaaagatacggcttacaatgccatttttcctgtgaaaacgttcttttaactttcccatatttcctctccttttcttattatgtttgtacgaaaatcccctttcgcacgttttcgtatttatattataatcttttcgttggttttcggctattgggataaacagagattttattcacgtaattttgttaaaatttactatttattcatttttatgtaatatatgcgaaatctttttagtactaaaggtcctagatataatagataatttttcatttgaaattttgtgaattattttttaagtctatatgacatgatttaagggtcaaaaccaccttataaaaaatgattggtaccttgaaaatgtgaagttttcaaggtaccaatttatggtttacaagggattgatagcatagtaggcagaccttggggagctgtaatcactaaatctttaaaacagctcccaaaattcagcccaaaaactggataaaatccgagaaaagtagctgtaactgctgaaattttcaaaacagctccccaaaaccagcccataagccagataaaagccgagaaaaagtagctgaaatcactataattcccaaaacagctcccaaaattcagcccataagccggaaaatatgaggcttatggcataatggtggaagcctctagttatttcacaaaaaagagcctgcacatttctgtgcaagcttcttttgaaaactaaaatctaaaaaccaaaaactaaaaatctaaaatcaaaaactaaaaaattatactgttttttaattatatatttaatctctaaatcagctatccccagatgatttcttccttggcggcctccacattttcctcggaatgctccacttcctttgagaagatccttgccacctccatctggtcctctatggtgaagctgccaccgtttttgtagaagcgagtggcattcatatccctgactatcatggtaaacatgacgcttaaatatgcataaaccatgatatttgagtcatagatggcattcatgatatatctgaaggtaaagtatacaagaagctgctcaatatcgttttcacggtaatcgccgctagccatgtactccttcatgcgtttttcataatcagcctcagtgaggactgtctgcatatcatccttgaaatcctgccatacctgacgcaatagttccatctcattgatgataccgaagcggatatcaaaatgctcaaatgagaaatcattaaacgaaagccagtctatatgcttttcaacatcgttttggctcagcttcttctggtactcgtttgccctgtcaaggtactcatccacgcgtactccgattggctttgtcctgtcctggagtatggcaatcagctcgcgctgcacctcctcaaaaaatgctgcctcttcctctgtgactccctggtcatcatcgctgtcgccaaaaagctcctgctctacaaacttaacaggctttgttttgctgaaaaatatacggcagacctcctcgcacgcaaggctcagacacttctgctccacgtttctgtactctatgccaaaccttggaaaatcggtgcacacctcactaagcgatgcctcgccagctgctatgtacaaatcacacagattcttgtcatttagcataatgcagcgcccgcaattgtttgtacggatgccgtgcccgccatcctccgtctcatacatgccctttctcagacgctctccgacctctccgggcagtgtctgataatactcatatgaatcctcatcaatatcaatctcccagcccagacagcagctatccttgcagtctccggctatgcagctaaactctgaaaaataatcaggtacacggactatcatacttctctctccttcagtaaatcttcgtttgttgtatcactgtgcttatttctgaagcgcgcttctatagccgcccagtcagggtcctcatttcccttaaaaaagttgtagcctatgtatccgatgcaccacacaagccctgcaaatgtcgtagaaaatgctatctttatgatactcttaagcaagagtggaagtgtcagcatatcattgccaaatgctatgataatcacatgaataggcttaatcagcataagataacctcccacataaagcgccgctaaaattccaagcgcatagcacagtattcctaataatttgtcgcattttttcttcatttcaaatcctctaatcatattttcgtaaattccagtatagacacctctcctgttgctcttgtcttctccatgtctatcacacgctggtttgcagagcccttgaatttgagcgtgatatccttctgttcctctataaacggaccatctaccaggacatctatcatagataaaagctcatccgtatactctgtgtgcttgcgtccgttttctaacagttcttcgtacagatagcctgtgtaagcccacacatccttattgggatagcgctccttaactcttctcataaacggcacaagcgcctcctgattctcctcctcaaaaggatcaccgcctaaaagggtaattccctgcacataggcaggcttaagcgagtcgagtatctcgttttgtatctgttcatcaaacggctctccatagtcaaattcccatgtctgcggctgaaaacagcccttacagtgatttctgcagcctgatacaaaaagcacagtgcggcagcccagtccgttcgctatgtcacaatattttattcctgcgtagttcatactttttcctcgtatctgagattatagttccatttaaaaattgcactgcctattattataacatatcctatcacacttagatagtccggtatctgttgcaaaaagacaaatcccagcaaggcggcaaaaataacctgcgaatagtcgaacaccgatatctcctttgcaggtgctttggtatatgcctttgtgattgaaagctgtccgcctgtagcggcagctcctgcaaaaagcagcatgacaatctgatatacactcataggctttgctccgacaagcagaaacggagccgtcactatacatgaaaataccgaaaagcacatgactatcacaggtcctctctctccctgcttaccgagctttcgcacaaatgtatacgctacacctgcgccaaaacctcctattacaccaatcatggcattaaaaaactgcacattcatagatggcttcaccacaaaaacagcacctataaacgccgtcaccacgcacatccactctgtcttgtttgctttctccttaagcacaaaatatgacatgattatggcaaaaaacggtgacaatttgtttagaatattggcatctgcgatggccagatggtcaactgcatagaaattgcatataagccctgttgttccaaagaagcttcgcagaaaaagccccttccagctatccttttttattttgaagccttcatcactttttgcaagtaagataacagccgctactgctgctaccgcattcctgaaaaaggccttctgcatggtcggcaaatctcccgacatcctcacaaaaaatgtcatcagggcaaaaaagaatcctgccattataatatatattattccttgtttcttatcgttcatacttatagtataacgtattctgtcaagagggcataagaaaaagcctgccattttgcccgtaaaaaaggaccgcccgggtgagcggtccttttaagatgaagggaaaaatataaaaagaaaaagtttatatcaatggtctgtatcagcccttcacacttcccatggcaacaccacctacgatgtgctttgaaagaataaggtaaaccactattacaggaaggatagagaatgtaatcatcatgtatacctttcccatatcaaacttcaggaaatctgcacttctaagctgcgctaacaggattggaagtgtcttcctgttgttttcgtgtaatataagtgccggagtgaagtaattgttccagctgcttacaaaggagaaaattgcctgtactgctattgccggcttcatcaacggaagcacgatatgattaaatgtcctaaactctccggagccgtcaattctggctgcctcaatgagagacaacggaagtgagctctccatatactgcttcatgtagaaatatgtaacaggtgaagcaattgtcggaactataagtggaataaacgaatccatcagtcccatgcctgttactaatttaacaaatccaagtgctgtaacctgtgtaggaatcatcataaccatcagtatgaaggtggagatgaatttcttggccttgaactcatatgcatgtatggcatatgctgtcattgtcgaaaaatatacacacagtactgcactgcaggctgctacaaaaaggctgttaaacatacctcttatgaccggaagtgtgtcatgtaagagtgagttccagttgtcaagcagatgcgtactcggaattgccgtaaatcctgactggagttctccgtttgatctggtcgcattgattatcattacgtagaaccagaacagacagaagaaagagattatcacaagcacgatatatgctaacgcacgtctggcatggattcccatacctttattttttttgtttacatttgctgccatatcgacctactcctttctcttatcatcgttgccgctgagcttgaataccgctatgctaagtattgccgtgatgataaacagtatgactgacaatgcaccggacattccataatccttactgtacagacgtttgtttaagtacatgataagtgtcatgcttgatctgaccggattaccggttccgtttgtcaaaatctgtggtacatcaaagagctgtaagccgccgataagtgatgtaatgattacatatatcagtatcggcctaaggagcggaagtgttatcttaaagaacacctgtgtagatgttgctccatccacctctgctgcctcaaaaagtgatgtatcgattccaagcatacctgccataagcaggatggttgtattaccaaaccacatcaggcagttcatcaaagcaatgagtcctcttgtactgcccacatgcgacaggaacttgtacggctctgaaataaagcctatctgcataagcagattgtttattggtcccccatcagcaaacaatgtaaagaataacagtgaaaatgctgaagccataatcagatttggcagatatataactgttttaaaaaatcttgttcccttgagctttaggctgacatccgaaaaccatgctccaaggagcagtgataagaatatctgcggtatgaagcacataatccaaagaaccattgtgttcttaaaatactgccagatatcaccggatgtgaacaatttttcataattttcaaatccaacaaaatttggtcctacttgtgtaagaccggacatataattttcaaaaaaactgttgtaaattgtagtgattaacggtaccagctgaaatactacgtatacaacgataaacggaatcagaaatatatagccccatttattatatctgaccgctttacctccactctttttcataatacctacctcccaactggtattgtagtcaatggtgatgtaatgctgttaactgattaactttgatttttaaaaagaataccccgcctgcctgcttacgcaaggcagacagggtatttattattttatattgttagttgtatggtcaattcataaactatcttattctgagatgtcaggatatttctcacaaactgccttcttgaatgtctcaatagctgtatccttatcgcagtttccttcgaagtaatccttcatagccttctggaactcctcgttgcagccctggtcataagctgaaaggttgcttaaatcgagagtcttaacaccggctatatacattggtaatggattctgtccaccaagtattgtacttgtgtaaggcttgtcgtccttgcccatgattgttccgtctgcaagaccatccataactgtgctgttgtttacgaaatcatcatccttaacaacgatatccttcatgatgtcatcgtctgttgtcatcttgagcatgatatcctttacaaggtcggcattgtctgttccctctgctgcacagatccatgtaccgccccagaagaagccctgtggtccctgggctgcaccccagccgccctggtttccgatagaacctgactcatctgctgccattgagaagtttactaaccatgcaggtccaaagtatgagaatacttttccttccggatagaagcccttcttccagtcatctgaccaaagatctgctgttcctgtctcgcctgcgtctacaagcttcttagaatcatcaacccacttcatgatgttgtcatcaatctggattttcttgtcatcgcttacccatttcttagaaacgttgttagagtatacacggtatgtatcgtttgctgtagatgtcatcttgtagcctgctgctttcatcttctcagctgtagcattgaaggcatcccagtcagatactgacttctgaacctcatccggatcatctgttccaagtacctcttttgctgctgctctgttgtagaagagaacacccgggcatccctgccatgaaagacccttcaggttgccctcagaatcagtaacgacatcctgtgtgtacttatactgcttagagatatcgctgtctgtgattcccagatccttgattggcattgtgtaatcagagtctacatacttaggtgcgtaatcagcctctaccaggaagaggtcaatcttgtcatctgccgatgcatcagcctgcttcaaaagtgtctcatcaaggttgttctggtacgcattgttctcactaggtgtgatattccagactacatcaatatctccgattttgccatgtgttgcatccaccttcttgtaatcaggatagtggtctgtgatacggctctggaactcttcattccagcagtagatattgagtgtcttgccatcgcttgaggcttcagtttttgcatcgcccttcttatcagagtttcctgtgtcggatgtatttccgctgccacagcctgccaataatgatgctgccattgttgcgcaaagtaatgcgcttacgagtttctttttcatagaaaatcctccttctcgctttaggttttaacctgttagtaaatgttagtaaaaaagtattaaaatatattaaattctgcctacggattccccctccagcaaaatcccttcaacaacagctctctccacaagtgctgttttaggctttttaatgatgcttatcagtctgtccgctgcctccctgcctatcttgtcagtgtcctgtctgatagtggtaagctttgggcttagcatctgtgaaactcttgtgccatcgtatcctgctattgatatatcatccggtatcctaaggcctttgcttcttatgacattaatgcctccgattgccgccgtgtcatccggatagatgatacatgtaggtttatcaggtaaatcaagtaagtactcagtctgctttgcaacatcctctgtttccagatactttgcttccctgacatactcctcaggaatgtctattccatgcttctcaagtgccctgtaatatgctgccagcctgtcacgtgtaacactcgaaaaatcctgtccatgtatgtaagcgattttcttatgtcccatgcttattatgtaatcaagcagctctcccatgcactttacattgttggaacttactgccgaacagctatagtgtacgtagtcaattgtgaccaccggtatgtcgctgctcatcagttcctgcacctcattgtcctgaaaccttgcacatacgattacgactccatcgaaatttctgtacttacagtgctccaggtatgataatttttttccgaccggacttgtattgataaatgtaatatcatatccaagcatctcagcctgtgccttgattccgtttagcactccggcaaaatactcatgcgtaagccccatcgccgcctcatcgaaatacagtactccgatgttgttcgactcgtttgtcttaagaactctggccgcagcattaggaagatatcccatttccttagctatcttctttattctgtttttggtctcagcgccaatatccttctggtcatgtaatgccttgcttactgtcgctgtcgaaacaccacatctttgtgctatgtctttcagtgataccatatcgtttcctcatttcgaattggtttcttaatcgttttcgtatcttcactataccacaattcattattattgcaacccctaatttacattttcaacatttttaacactttttattatcttttattatgcattttgtatagtgttatgttatgtatttaaaacgattacgcctttgatcttaattattatacaattataattacttaagtgatattatctcatcagcatttttaactataatatgcagttttctttgtatatatgtcataaaagcattattttttattgttttatgcttgatttttagatattcgcattatatacttctatatataaacagcttaaacgtttgcgtatatttaataaaaaaggagattttatatatgaaatttggacacttcgatgatcaaaacaaagagtacgtcatcacctctccaaggactccgttaccatggatcaactacctcggatgtgagaatttcttttctctggtatcaaatacctgcggtggctacagcttctataaggatgcaaagcttctgcgtctcaccagataccgctacaacaacgtgccatacgacagcaacggacactactactatataaaggatggcgacacaatctggaatccgggctggatgccttctaagaccgagcttgactcatacgaatgccgtcatggcatgggctattctgttttcacaggagtaaaaaacggcttaatggctcagcttaccgactttgttcctatgggctctacctgcgagatcaataagctcacattaaaaaacacatctgataagaaaaaagacttttcggttttctcatatgtagagttctgtctgtggaatgccatggatgacatgaccaacttccagcgtaacttctctaccggagaggttgagattcacgtcggtggctctcagctcttccacaagacagaatacagagaacgccgcaatcactatgctgtatatgctgtaaatgcctctgttgacggatttgacacagacagggattcattcttaggtgcctacggcgaaaacagcgcgccttccgttgtagtaaatgatcagtctaagaactctgttgcaagcggctgggctcctgtcggctctcatcacctgaaggtagctcttgagccgggcgaagaaaaaacatatatatttgtacttggatatgtagaaaaccctgtgaacgaaaaatgggttggacgcgctgaagacggaatcataaaccgagctcctgccgatgcactccttgcaagatttgacaccaccgaaaaaaccgacgctgctttagcagagcttaaggcttactgggataagctgcttggtcactttagtatctcttcatcggaggaaaagcttgaccgcatggtaaatgtatggcatcagtatcagtgcatggttacctttaacatgagccgctctgcttcttattttgaatcaggcatcggacgaggcatgggctttagggattcctgtcaggatctgcttggcttcgtgcatctgattccggacagagcaagagagagaatactcgacattgcagccacacagtttgaggatggctctgcttaccaccagtaccagcctctcaccaaaaagggcaatgccgacataggctcaggctttaacgatgaccctctgtggcttatcgctgctgccgctgcttacatcaaggagacaggcgactactctattcttgacgagtcaacaccatatgacagcgatccttcaaaggcaactgactttatggagcatctgcgccgctccttcaactatacaatcaatcatctcggacctcatggtctgccacagattggacgtgctgactggaacgattgtctgaacttaaactgcttctccgaggagcctggtgagtccttccagacctttggaccatctgaaggacctaatgccgaatctgtttttatcgcaggcatgtttgtaaaatatggaaaagactatgtaaaaatctgcagacacaagggactttgcgacgaggctgatacagcccaaaaggctattgaacagatggaaaagaccgtcatggatgccggctgggatggcgagtggtatcttcgtgcttacgaccactacaagcacaagattggttccaaggaatgtgaggatggaaaaatctttattgagccacagggcttttgtgttatcgctgaaatcggaaaggatgaagggttctgccttaaggcaatgcagtctgttgaaaaatatcttgatactaaatatggcatcgtgctcttgcagccgccttaccacagatatcatgtggagcttggtgaaatctcttcttatccaccgggatacaaggagaatgccggcatcttctgccacaacaatccttggatttctatagctgagactgttatcggtcgtggaaacagagcatggcaggtatacacccggacctgtcctgcatacattgaggatatcagcgaaattcaccgcaccgagccttatgtatacagccagatgattgccggtaaagacgctcctaactttggtgaagcaaagaacagctggctgacaggtactgctgcatggaccttcctcgatgtctcacagtacatcctcggtatacgtcctgactacgatggtcttatcatagatccttgtattcctgacactatggacggctttacagctaagcgtaagttccgtggcaatacttaccacattacggtcagaaatcctgcccacgtacaaaagggtgtgacaaagctcatcgtggatggcgctgctattgatggcaatatgattccggctattaacggaaccggacacgatgttacagtcgaggttacaatgggttagagataccagacaggcctctatactgcttcaaatatgacccggaatacgaaaatgccgccgcagagcaagctctacggcggcatttagactgctggtgatgttcttcccatgtctttatttcttctctaaaggatgctgttatgtaattgagacctgccacatatgctcctcggtctctcccatgtgaaacagctccacagtctgttcatcatgagtatcatcaggctcatagttgccaagaagatgtatgagatacttctcctgctcatctgatgtagagaccttatcaatgtgtttttgcaattcctcaagaagctgctttggctccatgtcggcatcgactgcgattccaaagcacttcttcgcaagacctgcggtataatacagctcgtagttacttacaagcactgatttttggcgtaagcatttgagtatgatgctttgtctggctattgatgtaatcatattatttcctttccgagttagctggaatacctctaagtccaagttatttccattataccctatttgctttttgtttcaagagtataacatgatatagctaaagataacttaagagagtcctatgaagtggcaacaaatcccgtcaggaaataataaagtgctcccagcgcctttccaatagccatagaaatcactataatcccaagaccggcgcgaagcttcatgcgcttatatataatagggaatgtgtgcagtatttccgcgagcgcaactgcaatacagccgacaaatatgccgacacacagtccatatattgcaataattatattcccacagatattgcttacaggtactttgggcatatttgcaaagcccagattatatgccgtatcaagcactgatgatatattacctgccaccacaccacatatcatgacattttctataagtattatattttctatcctgctgcaccgaagtatgcgcggcaccactcctatcacgagcacgaatgcaaatacaccggctgacactcctgcccctgctaaaaacgctatcactgacaaaaatatttcacgcaatatatattcaaacatcctgcttttcctttaccttgtctattattgtgttccacgtatctttattatgcttatccatctccacctgaatcggtgtgacatcgtcggatagcttacgctttccgatatgattaaaaaacagtatgattccgaccgccagaccaatgcagtaaaacacctcaagcaccgacacctgtggcttgtccacacccattatctgcttataaaaatgttcaaacacacctgatatcgaaatatcattattgaaagccatgattgtaaaagctgaaccaaaaaatataagtatacacaccgctgcaacctttagtgcttcaagaatcttatttttgctgttgtcgtcatactctacaagtacctccggctcaccaatgcttataacctgtgcatcatcatagatttccgtgatttgctctattattttcattacagatatcacgctctttttaccgcgtatcttatccacgattattccctttatctgtccctcatagcgtgaatatttacaatacacacttgctatgtcattgatgcagacctgcctgcggtgaagtgttttctgcttttctgcgcgtatatacacgagaattttttcttttggggtatcagtatgctccggcatcttcatgctcccttcgattaatattcatatgtatataatttccatttattttgattttatacacaaaatacacacatgtaattaaatcaatatttttcgtgcgatatattgtttttttcgtgcaaacatcataaaataaatataattaatctaaagagtgaggtaacaaatggcatacactaaggaaatactgactctcgccgtggaaattggcgactgtatgctcagaaacggtgcagaaatctacagagtggaagacactgtggttcatatactaagttcatatgaggtggaggaatttgacgtatatgtgctgtcaaacggaatatttgcaagtgcaaatgagaacaaggaggatgcctgcagcatcgtgcgccacgtcccccttggtgctgtcaatctggcaaagatcagcgcgttaaaccagctcgcaagggacatatgtgaccagaaaatctccctgattgactcatgggacaggcttgagcagtgcaaaaatattcctaattacaaaaaaagcgcacagattttcttctgtgggctcggaagtgcctgcttttgctatctttttggcggaagctggcttgactttgtttttgcatttgttataggctcactggagcaggtgcttttgtttggtcttaaaaaatataagttcacaaggattataaccaatattcttgccagtctttttgtgacactgcttgccaccgcaagtacacttacagggctttctcttttacctgataaaatcattataggagctatcatgccacttgttccgggaatagcatttacaacatctatcagggatatatataacggggattatctgtccggtacaatacatctgctcgatgcactgattacagccgtgtgtgttgctgtgggagcatgtctgccgtttgttgtgatgaaatatattggagggatttaagctatggagtttataatacaatttattgtggctctctttgccacattatcgtttgcagttattttttccgctccaaaaaaggagctgttttactgcggttttacaggagcgcttggctggatcatctactatataatggttcagtttgatatgggtgttgtgtttccatcgcttatcgcgacactgtgccttacgataatggcgcgcatttttgctgcggcacgctctatgcctgtgacagtttatctgctttccggtatctttcctcttgtgcccggagcaggaattttttacacggcatattatctttttacgaatgacagagcactttcctcctcaaagggtattgaaacctttgaggtggcgggtgccatcgtgcttggtatcatattcgggtttggcataccgcagagtttgtttaatctgttgaagcctaagaaaaaatgaattacttgaactatgtcaaatttgcaattttctgcgccagatcctcgagatactcccaacgctccattttctccatcagctgtccctcgaggtcttccttttcctttgtgagttcgtttaacttaccaaagttagtggcattctttaccatctcatcatctatctcagaaagcctgttttccagcttttctatgtcagcctctatcgtctcgtactctttttgctctttgtaggtaaatttgagctttttctcatgcccccaggtttccatggatttcttcttccgggcttcttttgagtctgtaccatctgatgcagtatttccctgtgctcctgaagcggatgctcctgtggatgatgcattttccgatacggtttttcctgatgcaggctgtggacgtttattcatatagtcggtgtatccgccctcatactgtacgatttttccggctccctcaaatgcaaaaatacgctttgcaatcctgtcaaggaaatacctgtcatgggataccgtgatgactattccgtcatagccatccagataatcctctaaaatagccagtgtctcgacatccaggtcattggtcggctcgtcaagtatcaatacattcggtgcgctcatcagcacacgaagcagatagagtcttctcttctctccccccgagagcttgcctaccgggctgtactgctgctccggtgggaataaaaaccgctcgagcatggcagatgctgacacaagtccgtctgccgtgcgcacaaactctgcagcttctttcacatagtctatcactcgaagctcaggctctatatccacttcctgaccgaaatatcctatctttatcgtctgtcctatctctacctcacctgaatcaggctcgataaaaccggcgattatcttcatgagtgtggactttccacagccgtttttgcctacaaaaccgatacggtcatttttcaggaaaatatacgtaaaatcctttacacagacgatatctccgtatgcctttgaaatatcatgaagctctatggttgtccttcccatacgcgatgaaaccgatgaaagttcaacttttccgtctgtctgcggtcctttttggtctcgcaaagcctcatatctttgtatgtgtgccttctgctttgtggaacgagctcttgctccgcgctgcatccactctatttcttttctaaggatggactgacgcttgcgctcacttgccctctcactctcctctctggctgccttaagctcaagaaagcccgagtagtttgtatcatagctgtaggtctgtcccttgtccacctccacgattctgttacagacactgtctagaaaatagcggtcatgcgtaatcatgatgattgcacccctgaaacggcgcagataatcctcaagccactccaccatctcgtagtctaagtggttggtcggctcgtccaatatgagtacatcacacggcttaagtacgactgttacaagcgcaagcctctttctctgccctcctgaaagctcaccggtcttttgcgtcatatctgtgatatcaagcttcataagaagtgactttgcatcactttctatactccagcgcatgtcctcatccagctgcgaggtaaccacacggctcatcacatgctcaagagctgtctcgtccgggtcaaactccggattctgcggcagatagtttatcactatatgatttgctgtggtgacagttccctcatcaggctcttcatcaccagccacaatctttaaaagtgtagactttcctgtaccatttatacctatgataccgattttttcgttttcctgcacataaaaggaagctttagaaaaaagcttccttccagtatatgactttgttatattttcgacattaatgatgttcatcttctcgtattttctcctccctctcatgctcctgcttctccttggcctcaaggattgcctcattaagcgaaagcatctttgcatcaagctgtcctacgatacctgcacactcacgcagatcgcggctgatatactcaggtgcattgccctcgaacttgtaatatatcttgtgctcaaggcttgcccaaaaatccatagctattgtacgaatctgtatctcaacctttgtatcttccaccttgtttgaaagaaaaataggcaccgaaacaatcatgtggtagctcttgtagccgctcgccttcggatgcttcatatagtcctttaccgatatgacggtcaaatcattctgcctgccaatcatctcagcaagccggtatatatcagatgtgaacgagcacacgattctgatgcccgctatgtcctttacatatgtgaccatattctctatggtgctctcgtagccaccctttttgagcttcttaactatgctttcaggagtcttgatacgcgactttatgtactctatcggattgtaattatgtatgtgaacaaactcgtcatttagtatctcgagcttagtattgacctctttcagtgcagaattgtatagaaacatcatagtctcccagctatcaatgccctccgcaaactcttgttccattaaaaacctccctgtgatctattcgcctgtatatttatcagactctcttaatcaattatagcatatttattcgcatgattggcaaattatacctattatttatatattttttattcttgttattttatatgggttattttatatgttgtttattttgtatgtgcacaggtccgcacgctacaggcacggcggcacacaagtactctctcgtaagcgcatagcgaagctatttagaatctgttgaattatgcttcacaaccagaaatgcaccggcatggacgccggggcaaggcgttatgcgccatggacggcgcataaaagccggtttcgtcgagcatcgaaaaccaaaaggcataattcctacagattcttaatggcgtagcgtagcgaacgagagagtacttgtgtgccgctccgtgcctgcagtgtgcggaccgtccttatatcaataataactcatcatatccataatgaggcattaatcctcctcgatgatgtgcatctcgagaaaatcaaagtcgatatcctccacaaaattatccttcgtaaagcgtgtctttccatgcctcttgaaatcacttacattgctgtcaagccagatgggctttcccaggtcaaaagcaaggcaggcatcctcaagagccttaaaaatcttgtgtgtacgtgtgtcgtcactgtcattttctattgtaatatcacgcatcaggtgcgtgtcagtataaatcttaaaccaaatacgcatattattctcccaaaagtcttctctgacgattgcactcatacatgagcaaagtggctgatattgcggcattaagcgactccacagctccctccatagggatgcggatatatgtgtccgccatgtcagctatctcatctgataatccattgccctcatttcctatcataaagccacaggctccggtgtagtccggtctgtcataagagcacttaccctttaaatgagctgcgtagagagaaactccctttgactttgcatactctatagtctccggaaggtcatctgtgatgtaaaacggcacacggtagagtgagcccatggttgagcgcacagtctttggattaaaaatgtccactgttgtgcgattcattataatgccgcttacacctgcaccctcaccggtacggatcatagtgcctaagtttcccggatcctgtatactctcaagcacaagaagctctgtcttgtcgcccttaaaaagttcatctatctcatagtgcggcatctttactatagcgagcaccccctgcggagtctgcgtgtcagacatgctcttaaacaccgagtcactcactatttctgttttgtcaaggaaacgcttcttctcttccttaaacctgtcatcattaaaaaatgactcagacatatatacggcacttacccagtcatatggcgcctcaaagctcatctttggaccctcaaccacgaatacgccctgctttttccgctcctttgccttgcttaaaagagcctgcacattttttatgcttttgtttgatgcacttgtaatcattttcttctctttctatattgatgatatgagggtcaaaaagtattttgcccctcatttatgattaacattcgtctttctccgaatgcataaatgcccctgcaccggcacatgcacgcaattacctgcatttgatgtgccggatacaagggcattcatatttatcgtaactatattagatactaaaccagagatttagagatatcgtacatgtactcgtctacactcttcttcatagcaagtgcctcgtcgatatcgaaatctacgaaattgccatccttgtgggcaataactctgtttgacttgccctcgcagagtaaatcaactgccatagcgcccatgattgtagcgtatacacggtccttgcatgaagggcttccacctctttgcatatgtccaaggatagttgctcgagtctcgatgcctgtagcagcctcgatttccttagccatctcctgtgaatgtcctacgccctcagcattgatgatgatgtaatgctgcttgccgagctctcttgcgtgagctactctctcgatgagtgcctcaaggttgttgtcatacttctcaggaagtaatacttcctcagcgccgtttgcaagaccacaccataatgcaatgtatcctgctccacgtcccataacctcaattattgagcatctctcgtgtgatgtagatgtatcacgtaccttgtcaatagcctccatagctgtgttgcaggctgtatcaaaaccgattgtgtaatctgtacatgcgatatcaaggtcgattgtgcccggaagaccgattgtattgatgccaagtgcagcaagcttctgcgcaccctggaaagatccgtcaccaccgataactacgatagcatcgataccatgcttcttacagatttcagcacccttctgctgtccctctgctgtaacgaactccttacatctggctgtctgtaagattgtaccaccgcgtgagattgtgtctgaaacgctctttgaatccatatccacgatttcttcatttaacagacctgcgtatcctctcttgattcctttaaccttcttgccctttgagagagcctgacgaacaacggcacgaattgctgcgttcattcccggtgcgtcaccaccacttgtaagtacacctattgtgttaatctcttttgccattggtataacctccatatgttaaaaaattatcatttattctaatcccaatctattgtacttgttttagcacattttttcaatattcttttcaacaattttcgcattttctttgtctaaaaattccaaaagctgctccatgagctcattatttgcatttacggaataatttctgccaagttttttcatctgctttgtatctgcgatgtaaattatgacctcatctcctccgtcagattcacggattgtctcaagaagcctgctctcatttttcttatagtcctccatcgtatcaaatctgagccatagctgcttcggaagctcatcaaacggtatgattttctcgcagattatcttgccgttctgctcatcctcgactgtcgcatgtccgataacaaatattttagcatcgtcctgtaaatatctctggtagcgctcgtaatctctcggaaaaataattacctcaacagttcctgtcaggtcctctatcgtgataaaagccatggcctgattgtacttggtaaacttaatcgtctttgtagctatcatgcctccgattaccacgtgcgcattgtcctctatctttacggcaccgctctcctcttcaagcacaaaatctatcgcatttgctgtgatgtttttctttagggtagctgcatatttttccagagggtgtccgcttaaatagatgccaagcacctctttttcataggccagggcttcctcagcgtcatattcaccaacatttggatacttaagctcaaatgactgcctatcctcatctgagaccaggtcaaacaggctcatctgccctgccattgttgactttttgtcatgctgcaccctgtccacaatcgatgcatacaccattgccatctgctttctcgtgccgtcaagcgaatcgcaggctcccgcctttatcagattctcaatcgcacgcttgttgataagctccttctggcaggttctctcgataaaatctgagagtgtgcggtatctgccgccactttcccgctcctcgattatctggtctattaccggcctgcctagagatttgatggcgtacatgccatatctgacatggtcaccctctgcggtaaactcgccctgtccacagttgatatccggcggaagcaccttaatacccatatcacgacagctgtaaagatactgcgccgccttggctgaattgtctataacagaagtcatgagcgctgccataaattcgaccggatagtaatttttaagccatgcagtctgaacactgattttcgcatacgcggctgcatgtgatttgttgaacgcatacttagcaaaatcaaccatcgaatcgtatatgctgttggcagccttttcatctatgccgtttgccacacagccctttataccgcgctcctcgtctccgtacacaaagctctggcgctctgcgtcaatgacatactgcttcttcttactcatggcacggcggatgttgtccgcctgacccattgtatagcctgcgagcttctgcactatctgcataacctgttcctggtatactatacagccgtaggtcggctctaaaatactctcaagctcaggtgtcacatagcttatctcctttggattgttcttgccctttatatagttgggaatgaaatccataggacccggacggtagagcgaaataccggctacgatgtcctcaaagctctgtggactgagttccttcatgaagctttgcataccggcagactctagctggaataccccttccgtctttcctgttccgataaagtcaagtgtgcccttatcgttgaaatcaatatggtcgatatccacatcaatgccccttgatgccttgatattcttcacagaatcctttagcaccgtgagtgtacgaagccccagaaaatccatctttaaaaggccaagctcctcgagctgtaccatgttgtactctgcggtagggcttccgtcgtttgcccttccaagaggcacataatcgctcgccacacccggatagattaccacacctgctgcatgcacggacgtgtggtttggcagtccctcaagcctttttgccatatctatcatttcatgcactctcgcatcactgtcgtaaatgcccttaaactccgggttcatctgaagagccttgtcaatcgtgatattaagctcctgaggcaccatctttgcaagcctgtcagtctctgcatatgggaaatccagcgcctttccgactgattttatgactcctcttgctgccatcgtaccaaaggtgactatctgtgttacagaatcgtgtccgtacttctgctgaacatactctatggcgcgatatctctccgcatactcgaaatccacatcgatatcaggcatggaaactcgctcagggttaagaaatctttcaaaaagcagattgtatttaaccggatcaatatccgtgattccggtacaatagcacaccctgcttcccgccgctgagcctcgtcccgggcctacccagcagtcgtgcgtgcggcaccagttgatataatcccacacgataaggatatactctataaagcccattgtctttatgataccaagctcatagtccatatctgcatgtatctttttaagctcctcatcactgtactcgccacagcctatgtatttctccctaaagcccttctcgcaaagctctgtaaggaaggcttcggcactatcatagccctctggcacctcatactttggaatcttgtaattgccaaactcaagtgtcacattgcatctgtcggcaattttctgcgtattctcaatagcctctatggcatatgggaaaagcgctctcatctgctcttcgctctttacgaaaaactgtccgccatcatagcgcatcctgtcctcgtcagacacctttttcccggtctggatgcacaaaagcacatcatgtgcctccgcatcggactcgtaggtgtagtgcacatcattagtacacactaaccctatttcaagctccttgctcatcctaagaagctgctgattcacaagcttctggtcatcaatgccatgatcctgcagctcaaggaagaagttgtcttttccaaagcagtcctgatacttccttgcaatctccttcgcctcgtcataaaagcctcttacgatgtatctggggatttctcctgccagacaggcagacaggcatataagcccctcgtgatatctctcaagcgtctcaaaatccactctcggcctgtaataatagccctctgtgaaccctattgacactatcttcatgagattagcatagcctgtattattttcagctagcagaatcagatgataatacctgtcatcaccgtggcttgtctccctgtcaaagcgcgaatttggtgccacatatacctcgcagcctatgaccggattgatatcatttgcctttgccgtcttgtaaaactccaccacaccgtacatattgccatggtctgtgattgcggcagagttcatgccaagctccttgacgcgctttacatattcttttatcttgtttgacccatcgagcagactgtactcggtatgggtgtgaagatgacaaaatgacatttggattcctctttctttatttttgtatcgcccccgcccttcatggggtgtgcggctatctcctcaaaataaaaggagacaagtttatcagtttcccagctctatgtgtataaacaccgcaagcgaattaggctcctgcatatatgtgatagtgccgcctcttgccgtcggaatcagatatttgtagtcacccttatcgaaaagactgtgacatgcagtatcataggtttctctgtccgaaaacttgaacgtgatatagttagatgacgttgtcatgccctgtaagactttaaggtcgtaggatgtaaaatacagcccattcctgtaataatagtcatcctccacagtcgcttcctgcggcagcatatcctcattgtccaatgtacgtgtaagctttaccacatcaagcggcactccgaaccagctgtatgatatgccctttcccagataatcaccatcaccgtaggtacagtccactgcacaccacgcaccgtccagatataccatattccaggcgtggtttgcatcagatgtggtgcctgtcacaataagtgagctgataccggcccggtcacacagatacttaaacatcatcgcatagccctgacagaccgtccttccaagcactgctgagtacatatcctggttgtgaggagaattttcctcatactcggcatgctctatcacatattcatagaaatgcacagccttgtcataatccgatgcaccttcatcgatacctgccatacaggctgacacatagcctgaaatcgtacttattgcgttgtcgatatcagactcagacatattgtatacaggcgaaaaaatgatgctgtttctcacagtatactgactcttttctatgtagaaaaactgtggattgtccagcagcacaaactgctgtatacggcttacgttgtcagtgtctgtagtatttaacgaaattccatccatgcgcttttgcatcatcgcataaatctgcctgtaaataagcttgtcatcatctgacagcttctcgtagtagtagtgatattcccctgtaaatactgactcatcgtactctgtctgttcgccgtttaaatagtctgttgtggtctgcatttgcccctttactgccctgtgtatagctgtaggaaaatcagctatagcacctgtaaaccctcctgcctttaagcattttgcagcgaacataaagcaacaggcagcaaacacaagtgccggtatgatttttaaaagctttttcatctattcccccattttaatcgttgtctgtcactctgttaggtgtgaacagcagccatagcaagcctgcatatcagatacagtacaaaaagatgcaccgggtaaaaggcgtaaaagacatattttagtgaaatgcctctttttccattgtaatagcgaagcggtataagcataaacagtgcaaaaaactctatggtacctgagaaaagtccaagcagtatgactgccacggcaaatgcaacatcccggtttgaagaaagcaggtacatcatgacaatgcaccctacacccgccgcaccataatcacagcaaagcacaaactctgcaataatcatcataacaagcaccactgataccattactatacacctgatcagtgtgacaaaaaaccacttgactgcagaggatgccttttctattttatcgaccgacttaagccaatcaagcactgtgatggcaagcaagcctaaaagcagtgtaaaaaacacattgttgctcttaaattcgagcactgtattgtttattgcaaggtcaaacggtatctcagagataagcgcgaatataaacatcctcgcagcatatttttccctgctgtgtgtatatttgaagccctccacaagcaggaagcagaaaacaggaaaggccatgcgccctatagaacgcatgacccagtagatatcaataagcgtttgtccacctatcccgttatttatcatctgaagaataaccgttgccgcaatatggtctataagcatggtaaaaatggctataagcttaagcgtgcttccactgataccagactttgcgataactttttccaaaatcctatactcctgccatatttacggtaattctgtcaagatgccagatatcgtccacatattcctggattgttctgtctgaagagaactttcctacatgtgcgatattgagcagtgcactctttctccatgcgctcttgttcttgtaataatcattaatcttctgctgtgcatttgcatatgagcggaagtctgcgaggataaagtagcggtcagccacctgtccctgctgtggattgagcagtgagttgtaaagctccctgaaaagctcatggtcatttggtgaatatgtgccgtctacaagctggtttactacctttcttagctcggcatcgttattatatacatcaacaggattgtagtcatgtctgttctcgtgtgagatgacctcatcagagctcattccaaagataaacatgttgtcagcccctacctcatcgaacatctcgacattggcaccatccatagttccgatagtgagcgctccattgagcataaacttcatgtttcctgttccggatgcctccttgcttgctgtggaaatctgctcgctgacatctgctgccgcaaaaataatctcggcattggataccttgtaatcctcgataaatactaccttgagcttgccgccaatagaagcatcgttatttatcacatcagccacactgttgatgagctttattgttttctttgcatttctgtagcctgctgctgcctttgctccaaaaatgaatgttctaggatagaaatccatagacggattttccttaatcttgttgtacagatacatcacatgaaggatgttcatgagctgtctcttgtactcgtgaagtctcttaacctgcacatcaaagatagaatccggatttacatcaataccattgtgctccttgatatactttgctaaacgcaccttgtttgctctcttaatctcagcaaactcctgctgtgcaacagggctgtccgcataagccttgagctttgaaagcattgtaagatctgtaatccagccggctcctaccttttttgttgcccagtctgcaaggagtggatttgcatgtgctaagaatctacgctgtgtgattccgtttgtcttgttattaaacttctcagggaacatctcatagaaatcatgaagctcctgattcttaagtatctctgtgtgaagctttgcaacaccgtttacagaatagcctgcaacgatagccatatttgccatcttgacctgtccgtcatagaggatagccatctttcttaccttgtcctcattgccaggatatctctcattaatctgcatcacaaatcttctgtttatctcgtcaacaatctggtatacacgaggaagcagtctctggaatatctcaattggccacttctcaagcgcctcagccatgattgtatggttagtgtaggctacacatcttgtagtgatatcccatgcatcatcccatgacagatgttcctcgtccacaaggattctcataagctctgcgactgcaactgtagggtgagtatcgttcatctggaaaacgaccttattcgggagatcttttaaatcgctgtgatgctttttaaaccttgcaagtgcacgctggatgcttgctgatacaaagaaatactgctgctttaagcgaagctccttgccctttacatggttatcgtttggatagagcacctcaacaaggtttcttgcaagattttcctgctccactgccttgtcgtagtcaccctggtcaaaggactcgagcgagaagccgttttttggctctgcatcccatatcatgagagaattgaccacattgttgtcataaccgactataggcatatcataaggcactgcaagcaccgactgatagtccttctgctcgaaatgaagctctccgttttcatctgtgctctcctgcacatatcctccaaacttgacctcatagcagtactccggacgacgaagctcgaatggatatccgtccttgagccagttgtcaggcacctcaatctggaagccgtctgaaatctgctgcttgaacataccatatctgtatctgattccacagccgtatgcaggatatccaagtgtggcaagtgaatccatgaaacacgctgccagtcttccgagtccaccgtttccaagtgccggatcaggctcctggtcctcaatagcattgatatccacaccaatctcattgagagcctccttgacctccttgtatgctgagaggtttataaggttgttgccgagagctcttcccatcaaaaactccatggacatatagtaaacaacctttggatcgtccttgtccatcactctctgtgtggcaatccactcatccatgatgacatcctttacggcctctgatacagcctgataaagttcctgctgtgtggcatcatctatagtcttacgatatttattttttaaattgtctgatacagtcttaataaacacctttttgctaaacgtattatctctcatcatattcctccttatggcactaaaagggagcaaattaatgctccctctcgtgcagagattattgtttttcaactgcaagcttaacagcctcaccattaatcttccaatccttttcatagcccttaagttcgcctgatttaattgatacggcaagaacctcggtcttgatttcatcaccaaacttttcaaatacatttgaaagcttctcatctgcctcgtatgtcacagcgatgtggtccataacctcaaagcctgcgtccttacgcattgtctggatcttactgatgatttctcttacgaaaccttcctcgataagctcaggagtgaggttggtgtcaagaacaacggttatattgttgtcagactgtgtcacatagccctccatctgagtcatctcgataagtaaatcctctttagataatacaacttcatcgctaatgctgtcaagcttgagagagccggtgctgttaagctcctccatggccttatgaccatcaagctcagctaaaactgccttaatctggccaaggtatttaccatacttaggacccactgttctaagctgtggcttgaatttgtaggtggtgtagtgtgatacatcatcagtgaactcaacctcttttacgttgagctcgtctgcgatgatatccacataaaattcatccagtttttccggagcctttacaaacatttttccgattggctgacggtttttgatatttgcctcgttacgacatgcacgtccgagtactacaacctttagtacctcatccatatcagcttcgagctttttgtcaatcagcttctcatcaactacaggatagtcgcacagatgaattgactccggtgcgctcttgtcgatagagcagacaagatttctgtagatatcctctgtcatgaaaggaatcataggtgctgccgcctttgatatggtgacaagtgctgtataaagtgtcatgtatgcgtttatcttgtcctgctccatgccctttgcccagaaacgctcacggctgcggcgtacataccagttacttaagtcgtctacgaactcctgaaggtactttgccgcctccggaatcttgtagtttgacaggcactcatccactcctgccactgctgagttgagctttgaaagaatccacttgtccattactgcaagcttatcatactcaaggctgtattttgtagcatcaaaattgtcgatatttgcataaagaacgaagaatgcgtatgtgttccagagtgttcccataaacttacgctgtccctcaagcacgagctttcctgaaaacttctttggaatccatggagctgatgctgtgtagaaataccatctgatggcatccgcaccgtatgtctcaagtgcatcaaacggatctaccgcgttgccctttgacttggacatcttctgtccgttctcatcctgtacgtgtccaagcacgatgacattctcataaggagccttgttgaaaaggagtgtagactcagccatgagtgaatggaaccatccacgtgtctggtcaactgcctctgagataaacttggccgggaactgcttctcaaatacttccttgttctcgaatggatagtggtgctgtgcaaatggcatggctcctgaatcaaaccagcagtcaagtacctctggtacacggtgcatatccttgccacactcaggacacttgattgtcacagcgtcgatgtatggtctgtgaagctctacctctgctgcctttggatctcctgctttttcggcgagctctgcacggcttccgatacactctctgtgtccgcattcacactcccagatattgagtggtgtgccccagtaacggttacgtgagatagcccaatcctgtatattctcaagccagtttccgaaacgtcctgaaccgatagactcaggaatccagtttactgtattgttgtttctgataagatcatcctttactgctgtctccttgatgtaccatgactctcttgcatagtagataagaggcttgtcacatctccagcagtgtggatactcatgctcaaatttcggagcatcgaaaagctgctttctgccgcttaagtcctttaatacctcaggatctgcatcctttacccacataccggcaaacggagtctctgctgtaagctctcccttgtcgtttacaaactgtacaaatggaaggtcataatttcttccgacattggcatcatcctcaccaaatgcaggagcgatatgaacgattcctgtaccgtctgacatagtaacatatgtgtcacatgtcacgaaaaagcccttcttgccctgcttatcggcaacctgcttagcgcagtcataaagcggctcatactccttgtactcaagatcctttcctttgtatgtctcaagcacctcatatgccttcttgcctgcttctgcgtcctcttttgaaagaagctgtgagagcaccttgtctgcaagtgcctctgccatataatatgtgtagccatcaacagcctttacctttacatatgtgtcattagggttcacacagagtgccacgttgcttggaagtgtccatggagttgtggtccatgcgaggaaatatgcatcctctcctactaccttaaaacgtactactgctgatttttctttaactgtcttgtagccctgtgccacctcctgtgcagaaagcggtgttccacaacgaggacagtaaggaacaatcttgaagcccttgtaaagaagtcccttattccagatttccttgagagcccaccactctgactcaatgaaattgtcgtcatatgtgacatatggattgtccatatcagcccagaagcctacagtgttggagaaatcctcccacatacccttgtatttccatacagactctttacacttcttgatgaatggctcaagtccgtagttctcaatctgatccttgccgtcaaggccgagaagcttctccacctcaatctcaacaggaagtccgtgtgtatcccagcctgctttacgtggcacatatttgcccttcatggtctggaatcttggaatcatatcctttatggtacgtgtctcaacatgtccgatgtgaggctttccgtttgctgtaggaggtccatcatagaatgtgtatgtctctccttcttttctgttttccatagattttctgaagatattgttctctctccagaactgctctgtcttcttctcgcgttcaacgaagttcatattggtgtcaactttgttgtacatgactatctctccttattctatattgttcgtgaacatcccaacatgcacctcaaatttgactcttacgaggcttccttgtggcttactccactagaattttcggtttatggaatattcacaaaaaaaggcacacattcctgtaattaggaacgcgtgcctgatacgtctataccacctattacaatgtacttaagggaaatacccttgcatacccgcccctgtaacgtagggaatacgtcagaacctactctcgcaacgctgtatggcgattttagcctgcggctcagaagtgattttcaaaacggctctactcataccggctctcacctgccccggctctctttgactttcctgccatctctactgtcttcgtcactgccttttactaactgtgtttaagtatataactgaaaagccactgttgtcaagatgtaattgattctgtaataatttgataataattaactctaataaatgccatcatactcaaaattctgataatcaaaatcatcataatcataagaatcataatcataatcgtaatcctcataggaatcgtcatcattataatactcatagccctcatcaaagcccttcatgaactccttttcaaaatctgtgcttacgtttgagcctgctataacccagaatatgatgctgactataactgagatagctgctgttgctataccaactataccaaacaccttgttgttgccctttatgatatgtataataccaaaaatgatagcaagcagagctgtcacataattgatgcatgtacaaaacagtacaatagatgcgattccaagtaccagagaagctataccaaagccattgctgttctttggcggctggttgtatggattagctccatactgtggctgattgtaggctgtctgtccgtatgcagtctgattgtagccaccctgtccgtttggctgctggccatactgcgtctgtccgtaagctgactgattaaatgagccctgatcatatgtgttctggttgtatgtaccctgggcatttggattctgattgtatgcaccctgggcatttggattctgattgtatgtaccctgatttgcataaccatatgcactgcccggattattgacatatccgtctgtgctgcctgtctggtctgatgactgtccatgttcattcccactttcctgctgggatacagactgattatatgtgtctgtcggctgactgtatgtgtctgagccatttgctgttcctgaaggctgaccgaatacacctgtattgtccggtgtgcctgacgaccggttgtcattgttcatataattgttatcgtccataacttcctccatatatcctattgtttatgtagccattgtgttattgtgttagaaatattttatcatatattacaataatgtaaatatttttatcataaaaaatatataaaaatggcaggagcaaatgcgctcctgccgtaaaaaacatattactgctcttagaaatcaaatttctgactaagctcttcctcactctcctcaacagagtttttgaggtcatccgcaagcatatagatattttccagtaccttcttgcactttgccatgctctcgactgtggtatcagccatgcgaagtccctctgttgaagaagctgcgacctcttctcctgtagctgaaaggtgtgtgatattgtctgatatgactgttgttgaatcaagaatctttttgatactctcctcagccacattgatatccttcatcaacagctcaacggcctctcccatggcattaaacttgtctcttgtatcgtcgataagctcattctgcttctctaccgatgatactgagttctcgatactctcgttggcacgccttgtgtcctcattgagcttgtttataatctctgtaatattggctgatgcatcctttgtctgctctgagagctgtctgatttcatctgcaactaccgcaaagccctttcctgcttcacctgccctggccgcctcaattgaagcattgagagcaagcagatttgtctggttagaaatattgataatcgactcaacaaagctctttacttcctctaccttagctgtaagactctggataactgacactgtaacattgcttgcctctgccacgttgtgtgcctgctccttgagttcttccacaacatcagctccctgctttacggtctcatcagtctggcgtgaggcatctatcatagccttgattccactttctgcattgtctgtatttccctgaatatcaacacacatagctgcctgcttctggatagcctccgcagtgctctctgtgctgtctgctatctcctggattgaactatggctcaccgcaacagactcatcgagatcatttaacatggtcatagcctcgtcaaagtgctttgaaatattctccgcaaccattaccatcttcttattgctgtccacctgtgccatagcagattctttgatttcttccatattttcatcgaagaaatgggtaagaagaatcgtgatgctgtctgacgcatatcccacaagtacaagtacaaaaactgctatcacatcattctgaagaactgtaccccctattccaagctgcattacaagcctgatgacgctggatatgattattactgcgttcatcaccatcatcatctttatatccagatatatcatcgctgcaataacaagcggcagggcatatgtccatgtaccgattgttgaattgatcagtgcgataataaaatatcctgctgtcatggcgcttacaagtataagcgcacctgttctgctgtctctttttgtaataaatgcaattacagctattactattactgctattgccgcaacaagctgtatacttatcctggtaatatcagcatcttttgtcccaactgctgcaaataacgtaaatgctatatatgcaaatactatgattaccgccaggaatacacgtttgttggctctgttatactgttgactattcataaaatcccccttcttttgtttgagtttttagagtagctttattatacaacatttttttataataatccactactatttagtgccaacgtaccatttttctcattttgctcctgatttgaagaaaattctcctttcaaataaacatttacacaaaaacacccggcagttatcctgccgggcatcctgtaaaaaaatatttattctttaactccaccaagtgtaagtcctgtaacaaagtatttctgtaaaaacgggtaaatacatatgatcggaagcattgttataattgttgctgcggcacgaactgaggtaggtgtaactgcacctacagcatttttcattgcttctgctgatcctccctgatttgttacagctgaaagaagcttcataagctcatactgtaatgtagtaagctttgtactcatacggttataaagcattgcatcaaaccatgagttccactgtcctactgctacgaataaagctactgtcgcatataccggtttgcagagaggggaataaatcttcagaaaaatggtggtatatcctgcaccgtcaagctgcgctgattcctctaagctgtcaggaattccattcatataggtcctgataacgagcatgttaaacgcactgaccattccagggactacataaacccaaaaactattggtaagcccaagtcccttgtacaggaggaagacagggattaatccaccattgacatacattgtgataacccaaaacagggataaacctcttttgaacaaaaatctttttctgctgactataaaagcaaggattgcatttgccaccagtgctaagactgttccaattattgttctggcaacagtaatatatgctcctgttataagattatttttttgcaaaaccgttatataattcttccaggtaaactttcttggtaagaggtaaattccacctcttaatgcatctgtaccatcattaagcgatatcgcaagtgtattaagcaccggataaagcgttatgatcacaaacagtaccataatgatgccatttacaattggaaatatacttatcttctttttctttttgctctttacagagcctgctgttatatctgccatcgtacaagacctccttaaaacaactgctcttcaccattatgtttggcaattctatttgcaataaatataagaattatacttaccacactcttgaatatacctgctgcggtacctattgcataatctccctggcttatgccccatttaagtacataaatatcaatagtctgtgatacatcctgtatcagaccgtttcctaagagatactgtatctcaaatcctgcatttaaaacattacctacattcataagaagaaggattataatagttggtttgattcccggcagtgttacgtacttgatctttgcccagcgtcccgctccatcaatagatgctgcttcgtaaagtgaaggatctattgatgtaatggctgcaagatatatgattgcattccatcctgtttctttccatacattggcaaatgccactatcggccagaaatatcccggatgtgcgaaaaagtttatcggttggtctataatatgcatatttacaaggaactcatttacaatacctgttcctgaaagcatatcgtgtaaaatacctgttacaatgatccatgaaaggaaatgtggaagatatgatatagtctgtactactttctttccaccctttgatgcaatctcattcagtaagattgcaaatgctatggctgtgacaaaagttacaaccagattgataacacccattgcaagtgtatttcttataacacggataaatgtcatatccgagaacagcatcttgaatttgtccaatccaacaaatgcagaatggaatataccaagtcttggtttgtaatcctgaaatgccattgcccagccagcgagcggtagataatagaatacgactccatatgccaccattattgctgcccagaacagcagcactttctgacgtttgacttctttccatgtaatttttgttctaggttctctgaccttctcttttttgttttttctcgttaatgacatgacaccactccttaaagtcagcaggcagataaaacgctattatatctgcctgccttaaatttcatttaagctttatttgaatttagcagcctgctctaatcttttatcaagctcggtctgtaattcacccaggaaatcctgtggattgcatgcattgtatttatccatgtatgtatcccatgcactgtcaaagtcttttgccataacaacctttggaagctccgcatgcttaagttcgccaatctttgtccaggctactccaccaggagtgtctgaggtaaagttgttagagaatgaccacatcggataccagtctccaggtgcattgtttgttccaagcatttcaacgtatgtcttaacaccataggcatcgaaaacctcttttacatcactgttaagaccatcatagaactctcttgcctgtccatcaggtttgttggcattgattccatcatcacttgttccattgtactgtgggaagtatgagtatgggcatgaatgagaggccttgtatgctgtatcagaagccttctttctctcatctgctgttttgtaaaactcaccattctcatctacttcatagtcagtacccttgacaccccagtatctgagattgtggatatcctgatcaagaagatcatttacaaacttcatggccgcatctacatcatcacaggatgttgtaacagcaagacctgttgacgcgttgaaagcgccgcctgcattgtgccactgattgtcacggccgtcgattgttacaggtaccggaatgtaatcgcatccctgctcatcaaggcctgcctgtttaattgcatcacctgctgtgtatgcaaaatcccaccactggtcaatcattccaagtacacgtcctgtagaaagcttagagatatattcatcatatgtctgtgtgaatgactcaggatctacaattcccttattatactcttcattgagcttcttgaaatatttaactgctgtatcagatgtattatagtcaagtactttctttgtatcaggatctaccatacatgatccatcgtttggatatccgtcaaggaactgtggtgcattctcaagacagaaatatctccaatcttcacaaaggattgtatatggaatattttctgttccatcagccattgttggatttgcttcattatatttctcgatgaggtcaaaatactgatccagtgtcttgatctccggatagccagcccatttaagtactcttgcctggatccagaatgcctcgtcattgtgtgtgcagactttctcgtctccctttatgcagctaaactgtggtatccagtagatatgtccgtcatcctgacgaagtttttcccactcaagttctgtgaaaagatttttgatgtttggatatttctcgatgtagtcatccagtggaacaagtgcgcctgcatcatataactgcttctgtccacttataccgtcaatgaaatcaggatactcgccacctgcgatcattgttccgactgcctcatctgctgtctgtccggtaagccaggtttcctttacccttacacctgtcttttcctcgatgatcttctggatttcattatcatcattgatttcagatcccggtacagcaaagaatgcatcaaactctttcgcacctccagagctaccttttttaccactatcattgccacatccggcaaacagtgttgctgccatagtagccacaagcagcatgcttacaaatttttttcttctcatattgtaatgtcctcccttttgataacttaattttatactttttaagttttcaaacaatcggagtaactatagtcaaaaacagggtaaactatagtttctcgaaaaaactataatttaccctgttttgcagtaatatatattattctccactttgcatctgccgtctgaaacgcgccggtgtgcagccttttacctgtataaacctgttcacaaaataatccatatcatgatatccgacttcctctgctatctgtattatcttcttatcagtcctaagcagaagctctgccgcccgttccatcctgtaattgttcagataatccttaaaggactgtccgtatttttttctgaaaagctgccctaagtatgcactgtttacataatacttctcactcaggctcttaagcgtgatgttcgtggcataattgtctcttacttccttttctaccatgccgatcacacctcttgacacattttttctaagctgcgacagataatcaccatactcacagcaaaatcttgtcatatgtgcacggcttcccctctcaataccggtcttaaagctgctctcacttatgagtcgcaaaatctcctgctgatttacattatcatcctgctcacttgccaggtgtatgaactgaaacaacagataattaatatttaagttcatgctttccccattcatacccatgctggacatctcatcataaaatgtggcaactgcatttcttatctcaacatggttgttctgttccactgtcctaagcagcttatccagactatctttacaaagcactattccatctgccgatatctttacttcatcctcatagtaatatatgctctttactatgcgaaatccctgaaacgacctgagcatacatgcattgccgtatgatctggctatctttgatatatctgatacttttcttccgaccagcataactatattcttttgtgtattatcacatatataccttctcagatcctccagatattttctctcggtttttgtggcttcctctgccatataatctgagaatataaagcctatgtcatacactttttcatttacagatacatcaaatacacaatgtgccgaatcagcccccagaaaagcaacacagctttcgtacatcttgcgctgtaagcttctcatatcactatcgagtatctcatcacctgcaggaagctgctccatctgtatttcaacataccttgctccaccctcacacctcatattttcttttacatagttcaggtttacttcatcatatttgccctgtatcagagatatcaggtgtcttgcaaggtatgcctgtttcatctttttgttatcctcgttgatctggtttttctcgtttttgagcacaagaaccttgtttagtaccttaagcagcatctccttatccaccggctttagtatgtaatccgtacaatcattctgcatggcctgctgcgcatagctaaaatctgcataaccgcttaatatcacaaaatacacatctgattttttatcttttctcaaagtctcaagcagctcaagtcctgtcatctccggcatccttatatcggctatgaccagatccacattctcattttcaagaaactgcagggcttcctttccatttgaggccgttcctgctatctcaaattcttcattttcccaatcaatgatcaccttaagcccctgtattatgaaaggctcatcatccaccaataatactttaagcattttaaatctcctataaatatgtttccggtatttttatcataacagtcgtaccgcagccttcctcactgtccacatcaaatactgctttagattccgttaccattttgatacgcaggcaggcatttatcacacccactctgccaccggtctttaacatatcgatatctgcatttttcatgttacttttcattttttcaagagcatccggatcaattccgctacctgtatcctcaacctctatatgcatgaacccggcttttttgaatatacgcacaaatatccagcccggagcagctttactttctatgccatgcacacaggcattttcaacaaaggttacaagcgtaagttttggcacctgacattccatgcagtctgcttctatatctatgttatagttcagtcgctcgccaaaccggtatttctgcaatgccagataggcttttacaaattcacattcctttgcaacggttacagcatcatttccccactccacatactgtctttgcatgatggcgagtttttcgaccatatcagccgtctcattttcctttttcagcagactgtgcattcgtatgctctcaagcgcattaaacagaaagtgcggatttatctggctgtgcagtgcaagaagctctgcgtttttctgacttacaagcatctcctgctcttttagcttattcttatatacagtctggatcaagtcatttgtgcggcttaccatcctgttgtaattttttatcatgctgccgatctcatctttgctctccctgtcagtcatagatacaagcttttcgctgtcaactgacttaaatacctttgaaagctgtaatatcctgctcgtaaaggaatggttaaagatactgaacagacaaagtggaaagaatacatttataagcatcagaaaaacaataatcggtgcattgtgcataagcatgctccatatattactgcgtgtcttaaacacatatatatcaagatcacagccatacaaagagagcttctgcctgtatacggagtcgcttattttcccaatcgcctccaatgtcttaaatggtttgttgactccactgtaggccccatttgacagcactatgtcatctccatggcagataagcacttcattatcataattcatattcttaagagtacgcatcatgctgccataattaaactctatcttgagtaccttttcgatatcagatgagtaaaaatccagctttttcatataaatcatatgtctttcatctgacaatccggctacgcctttttcatatacaaaaaagagtcctccgctttccttctgctccagaagtctgtaagaatccgtatttcttacagcagacatatcatttacttttccgccatttactattgtaggattgtcagcatacaggaaaaatactatattgctcattccaagtgtgttttcaaaaagtgtatcctgaaagaagctctgatactctgatacatactcagcagagcttgtgtattcctttgatataaaatcgtctatgcgcttgctggtgtagatactcttagctgcctcttctgcgttattgaccatgctgttcagattatatcccacagcacttgctatgctcgacatttcatgtctgctgctttctttttcagcattttctacgatggaaagcaccactgcatcagtcactatgagcggcagcatgacacaaagtacataaaatatgtagaatttttttctgagtgaataatcatcaagctttctctcaatggcattccatattggtcttctcataaacaattcctctgaaatcacttaaaggagccgacatatgtccgctcctaaagtctgttttaacttgtcattaattatagaataacatatttattattaataatctacccctgttttctctccacatcttgttatatcaatgcgctctgtccgcttgcctgtgagctttgtgcttctgtcatcaggctgctgtcctcctgcggatatctcataaattcccggcacagctacacagcttccatcctcttctatcacagcaaagtcccttggcgaaagagtcagctttactttcttagtctcatatggctcaagctttacaacctcaatcccctttagctgatatcccggctcatactctgcagcatcaacgtgcctgatatagagctgaactatctcatttacagtatatctgctgtcatttgtcacatttacaaacacctcaacaggttcgtttacatcactttctgctttatccactgacattccatcatagtttgtctcaccataatgcagtccatatccaaatggatataacacattctcatttgtatagcggtatgtcctgtgagccattgaataatccgtaaactccgggagattttcggtgccctgataaaatgtaaccggcagttttccactcggactatactctccgaatatagcttccgcaacagcctttccgcctctggctcccggataccagctgtctataatggcatccacatgctcttctgcccaggaaagatctatcgcacttcctgctgacagcacaagtattaccggctttcctactgctgcaacagcctctaaaagttcctcctgaagtcccggaagcataagccccagcttgtcaccgcttgcatattcatttccggcatcaccctcttcaccttctatagttgcatcaagtccaagacacattacgaccacatctgactgttctgccatgatgagggcttccttaaatctgtccttttcctctgcaagtccctgtactttgtccttgtacagatggcagccctctgcataaagcactcttgtatcctctccaagatattgctgcaatccctcaagtggagtgatatatcttgatgaggtaccataataatttcctataagcgcatccctggagttggcatttggtccgatgaccgcaatagttttaacattttttctgtcgagaggcaggaaattgtccttattctttaaaagtacaagacttcttctggcagcctccacagaaagctccacatgctccttacattctacaacctcatacgatatgtcctcatatggcgatggataatccttcatcatgcccagacggatacgcacctccatcagcctttctactgctgccgtgatcgcctcgtccgaaaccagtcccttgtcataagcatccttaagatgtaaaaatgcacttccacagtttaagtcacagccgttgtttacagccatagcagccgattcctcaactgtatccgtcacatgatggtgttcgtggaaatcaagtattgcccagcagtctgacaccacatgaccttcaaatccaaactcgtcacgcagtatatccttaagcagtgtcctgcttccgcaggcaggttctccatttaccctgttgtaagcccccatgacagcctcaacctttgcatcctttacacatcgcttgaaggcatacaaatatgtatcatacatatcatgctttgatgctttcgcatcaaactcatgtcttatggcttccggaccgctgtgtaccgcaaaatgctttgcacaggctgccgattttaagtgatccggatcatctccctgtaatccccttatatatgcgcagccaagcttacctgtcaggtacggatcttccccgtatgtctcatgtcccctgccccatcttggatctctgaatatatttacattaggtgcccagaaggtaagtcccttgtatattccgtgatcacccttttttgaaaattcattgaactttccacgaccctccgttgatacaacatctccgatcttttctatcaggtcagtatcaaaagttgccgcaagacctatcgcctgaggaaatactgtagcaacaccggctcttgctactccatgaagagcctcattccaccagttgtattccggtatccccagtctttctatagccggtgactcatacagcatctgacttatcttctcatctattgtcatctgcgatactagtttttttgcatattctatagtttttttactcatagtgacttctcctttaatttatataatgattttaccagattcatgcagtattttctttctaattgttgccccacaatgttcaaaaattgctatttgtgctataataactatattcacgcaaatgcgcataaatatcagccgtatggagacaagtatatatgatcgaaaatctgaatggaatacatgagacagtaaaatataaagaatacagcaatgtaaagctttttataaatgcggaagcagaagattatcccattcactggcatactcccatggagattatcatgccacttgaaggcggctatacagtgcagattggggatgatttggtacatcttaatgagaatgatattatctttatagcttccggtgtaaaacacaggcttatcgcacctgacaccggaaaaaggcttatcctgcagattgagtggtctgctgtctcaaaaataaaggaattaaattccatacttacccttatagcacctgctataacgctaaccccggaaacttccggtgatatccacagcaatatccgtaaactgctgcttgatatatcaaatgaataccagaccgactcatttctatcagaagccgtgatctactccaaaatacttgaagtacttgtccttattggaagacatcatactgccagcagttgtcattttaatgtaggcagacacaagcagcaggaatatctggagcgttttctgtctatctgtgagtatatcgatacacattgcactgaggacataacacttgatgaaatcgcaaaaatagccggattcagtaaatatcactttacccggctatttaagcagtttaccaataataccttttacaaatacttaaatcagaaaagaatagagcttgccctgacccttctggctgatcccaatatatctgtcaccgagactgcaatgcagtcaggctttgcaaatccatccactttcataagggtgttcaaaactgaaaagggctgcaccccgactgaatttcgcaaaatgtttattgggtgagcattatgtatgaaaattctgcatagttatcactattgctgccatttgaggatgcatacataccgaccgtacagcccacaaagccacctgcttcttctgtggtatatggcagcagacttattttttctgcgacttttacgctcttttcggccgtacctatccatatagatgcttcctgttccttacagatcatacatatattccacagtggatttttttctgtaatgctgtactccataatatctgccactgctatctttttgtcagttcccttaatatgtgtagtcaccacaaataccagcctcccggcttccattgttatctcagcgcgaagatgattctcattgttctggaaaagtacaagtcctgccgtctcattatccgactgtgggataaaacgcactgctgtctttaccgtaaactcatagcccttctgtcttagtccaagaaatgcgcttgtgccaagatcagcgatctgctctttgtttgtgtacagtctcagtactcccggattttccttaagggagtaaaaagactcgtcgcgttttcctattccaaccagcctcttatcaggcttggattcgcagaaagttataaaatcattttctgatatctcatctataaatctgcactcttcaagcggtatatctaccgtatcctcaaggtgtcctatcccgggtgctattaccggccattcgttttcccatattgtttttgcaataaaggtctccctgcccatgctgctgtgctttttgcatggtcttgacgcaagcatgaccacataccagtttccgtttatatcatccaccagatcaccatgtcctgcatagatgaccggataatccatccccagatttctgtgtgtaaatatcggatttctcggacatccttcaaaccatttaaaaagctccgtgcttcttgctatcgttatactgtgctccggtccggtgccgccctctgcatgcatcagataataatatccgtttatcttgtagatatgtggtccttccggccatatgcagccctttacagcacctttccatatggccatgctcctgcccttaagcttcatggttccaagatcaagctcctgtatccatatctcccagtctccattgtaacgtactccttcagggtttgggcgtgtgccacagtaataacatctgccgtcatcatcgaagaaaaggcttgggtctattccgactgcttcttctcccaaataatacggatcagaccacggtcctgccggatcctgcgctgtcactataaaattgccgccatgcgatacattggtcgttatcatataaaaagttccttcatgatatcttatggtcggtgcaaaaatacctctcgatatttcttcattttccacgcatagctgcgatggtctgtcaagtatattgccaatctgttcccaatgagccagatcccggctatgaaatatgggaacacccggtgcatacacaaagcttgatgtcaccagataatagtcttccccgactctacatattgatggatcaggataaaaacctgaaagtattggattttttgctgttaccatgtctcttacctctcatttcctataatacatatccaaagccaagtatcgtaaactgcttgtctctgtcttcctctgcaatttcaattcttacaacatgattttcactggtcttattgttaaatattattaccgcattgcagtgctgccagttattgatatgtggatcagccgtaaaatgatattctccgtccacatatatcttcgcctttcccacgtttacctctcccgaatccttaaatacaaggagaagtgccctgcactccatctcaagctcgaaatacgcttttgccctgtttaatgtattttttgtgccatcatacatccagttatacgggaattccggagtcagcgaaagctgatcatccatctcaacgctttgcagctgtgtatctgtcgattcgaagccaccctcgtcaatatatgcctttgcatatatatcctttttgtcgagcagtcttatattttcaaagctgtttcctattaccggtgcaagatttagtttttcctgcaatattttttcctctgtcagtcccagttcaaatgcatccaaacttgcatgccctgcctgatctattttttcaaaaagatactctatgcagtctgccatgacggaatggcctgcattgcccggatgaaacatatcatagaaaaactgatttttgcttattacccttccctcgtcattttttaatgtaaactgaggggaaaccgcatccagcacgcttaccataggcagatcatagagctttccaaccgggcttaggcggtcttgaaggttccagtcatttgcaaatacggaaaaaagcaatatgactgccggtttccatggcagattaagtactttacgtacaaggctttcataacagtcaccctttgtctcatccccctcatcatttacagcaaattcaataactactatatcaggctgctgtccgtctcttagtacatccctgtcaaatctgatcattcccagctccgatggtgtgccacccacaccggcttttatgaatttcacattattctttgcagaaaaacgcctctggaaaagctgataggatttgtatgcgtagcactctgtatttataggtgtcgcacctgctccctgtgtgatagatccaccgatgtatgcaagtgttacctcttttccggctcttgtcttttcgatggcttttcttatgcggtatacatttcccatattcataagcgaatggcttatcatgctgcagtattcatcagagttcatatccacctctgtttcctcaatatctgccggagcctcatagccgtcattcagatacagcctgacactcgcttttcccatgatatccggtgtattaaatatgaactttatctgtcccggtatatcatcatccggtgtccacttataatctgacaggtatatctttctctccattccatcgcctgtcagctttaccttaagattagtaccgcctccgtacaggtcctgctttccgtacatctgaaacacaaattcgatctgttcgttttgattatctgtttccacagatacacctatgctgtgtacaagcctgccaaaaccttccaccgtctctaacagccccagttcctctttattttctatatttccggctatctgtgcactgtttatcagtcttccgtcgctttcatatataaaatgtataatgcttccatcttcctgtactgagccgtatatatccttatccttcatgatgtagaaatacggtctttttctttcgggatcctttggtgcttttggccctgccatctttctgcctccttgttatgtcgattttatcagctataatgattatatgatacaaaaactcccggtgctttgcaccgggagaaattatagatatttgtcctgtcttttatagtttatgactgcttcatcattccagcttaaggttcttgtatattaaaatcaataaatcctgtaatttcctgaaagtgctaacattgcaaacatgtaaaggaaattgtcatagtatctcctgtcacctgtcctaagtggagtgttccagaacttttcaacacattgctttgcatattttccatctgctgcgagtgaagcttctgcattaacagcaatgattgctaccggatgaagtgccttctcatcaagcggtgtaccatctataagaaatactccatcccaattgtccttctgatcctcacaataaaacttctgaagcctttctgccgttttaatctgccacggatctgcatcaaaccacagatgatccatcgctatattggcgatcgtgcggtatgcatcactgtaataccagtcatgtcttccaaatatttccttatgccccgtatgaggctttccgtcataatctgcatattctgcgctaagtcctgtcttttcatggcatgcactgtgcagatatgctctgctggcagctgctgcttctttccagaagtcccggtcctcctcataagccctttgggcaaaaagttcataaaaatgcggcagatggtatgaaggatcactgaaatccatatttgtgacaaactttatcagcttgttggaaggctcccacattggctctccgctgtgtcccggctcacccttgtgtacacactcccttaagatattttgtgcctctttgctgtagcagaatataccatcgccatctccccatcttttagaggcgaaaaacaatgccattgcaaaatactcttcaccatcaggtgccggtccatcggcatttcgctttccgtttgtctgacatgaccacgcaaaataattttttgccggaccatcttctatgtacatatatgtgcgcacccatttccacagtctgtcaaactctgcttttttatccagctgtacacataccatcatgccatatgacattccctcggttctcacatcatgattgccggtatcctccatatatcccatatcatcaccggcttcatgataaaaacgttcatcatcattcccatagaatatcgtgttaaaagtatcctctactcttttttgaatttcttcttccggatacccatactctttgaatatatttctgtatttgcctgtcttatatgctcctgccatttttctctcctttttgtcgctgttttactgtatcccgcacatgaaatttacaaatctgtgtctgcatgatgtccaggattcattatctcctttttttaaccattctttctgtgcactgtccttaattccgtatatggctgttatgttcccgatgatatcatcagatatcgtgctgtctgccattattatcataattccttttatcctgccttcgccagacagattatccatgatatttgctatctttccctgatgtatccagcaaaaatttctttcgtccgcagcacactcaagcacacatactctgccggtgtcacagttatcctctccataaccggctggtgtataaacataattcatactgacctgtccgtctccatcacacgaataatggatatgtatctgaccatgatctgtttccttaagctcatgccagctaaagttcctctcaggtacctcagcaaagtttacagccctgttatatccgaacccgacaggtgccgcaggatttactacaggtgttccatttaccataaatgtcacatagttaaatccctctgccggattgcctattgttttttcccaataaccatcatttttctttgatctgtaaagaagctcctccgtgccattttcaagaactacgctcacgctttttgcatcaggtgcaaaaagatttacttcaatgctgttatcctccgtcacactgataccatgtatgacatccggatatttgccagccggttttccatcctcgtcattttcgaactgtatctgcctgtacaccggatcaaaaaataccatgctctcatccgcctgtaccggtgtggtaaaatcaatattctttgatctgaccgggacagctttatcaatatcatcaagttctgcgtcatcccatgtaaaaagcatctgtgcgaaatccttaaagctctttctccatacatgccattcatgatagccctcatatacttttggtgtactgtttttcccctgtcgtgaaaattcctttaccatctcattgattccaagcagtatctctttttcttcatctcctgccgacataaagacagcttcaaaccgatatgggctgtcgattatttttttcatgagatgtattgcaacacctgaaaatactccaactgctgaaaaaagctccggatgtcttgccgctatatccgtagcctgtcctgaaccaagtgaaagtcctgccacagcacggttgtttcttccttttttgaccttaaaattttcctctatataagggattatgctatttacaagctcactgtcaaaatctcccggaaaaaatacagggtattcgttatccttaaatgcgtagccactgcttgcaactatgatcatcggcacacattttttgtctgctatcagattgtccatgatgaaattcatcttaccctgccatacccatccggtctcattctccccgacaccatgctgtaaatacaatacaggataccttccatctccgctctcatatccgggtggagtatacacatagctctcctttatgtgaccgtttacctgtgaggtatatttgcacagacttaccgttccatgcggcacatccctgacaaaatagaaatcctcgccctcctccggcacttcaaatgtgtttattgcagcaaaacagccatatgatatagccgcatgaggatttgttatgcagacatcatctacataccagaaataataatgcattgcccagtggaaatctttaatgtttgccgaaaatccaccctgcatatcaggctttaactgtatgcgttctgagctgaaatagcctcccattccggctacttctactttattggcatttggcgcataaatataaaaagtaacacttccatcatcctcaagtgtgaccgagcatctgttattgtccattgatgatggtatcgtgcctatatacaaagcaccattttttaaatcatccaaaataaaatccccccattcgtttattgatatatacaagtgtaaacgaacaggggcttgttattctattaataaattgccaaacagtattcaaatattgctaattttcatttaccttttgctgtaaataatcaaaatatatctgtggattgcaggcattgtactcctccatatactgatcccaggcagcatcaaaatcatctgccatgataacctgcggcagccatattttctttactgccacaatattattctttactttcccacattcagaggtcaaaggaattgaatctgaatatgaatacatcggataccacgagccgggagcctcattttttccaagcatatctacatagttttccactccataggctttaaaacattcctgaatatcaacaggctgatttttgaaaaactcatcctgctgaaactccattgaaaacgcatttataccatcatcaagcattccctccactcttggaaagtatgagtacgaacacatatgcgctgtctgatatgagctgtcactttttttctctgcctgctcattggtaaggtaaaacaaaccgttttcatcgactgaatagtccttgccctcctctccccagaacctttctcttatgatatcagattccagaagatcactgacaaacttcatcgcaccttcgatatctttacaggaggtggtaattgacactcctgaagaataatctatttctgccatcctgtttgtatgccatctgttgtgaataccatcatcaatcgtgacaggaagaggaacataatcacacccaagctgtgccagattctgttttttgaatacaggatctattgcataataaaactgccaccactggtcgaccatcccaagcacagctcctgttgacagcttatccagatattgatcataggtggcattaaacgccccgggatccattattcccttatggaactcttcgttaagctttccgaaatatcttttggctgtgtcggtcacattgtaatccatcacttttttggtttccgtgtctaccatacagcttccatcgtttggaaatccgtccagaaactgcggcacgttttcaaggcaaaaataccgccagtcatcacaaagcatcgtaaatggtatattttctgttccatccggcattgttggatttgcctgtacatagctttctatcaggtcaaagtactgctctatcgttgtaatctttggatatccagcccattttaatactcttgtctgaatccagaaggcttcaccattatgcagcatctccacatcatccccatgtgatattccaaacggtggaatccaatatatgtgtccatccggctgtcttaacttttcccattgttcatcactgagatattcttttatgttcggataatcatcccagtattcatctattggaatgagtgcatctgcctcatacagcgcagtctcacccaatacaaaatccggatattccccggttgctatgagagaatttattgcatcgtccttatcctgtccaacaagccaggtttcctcacattcagcaccgatctgctctgctatgagctgctttatatcattatccggatctatattatctccttctacagaaaaaaaagccgtaaattgctttatttcttttttatctgacgattgaaaagtaacaccggctataagtccgataaacaatgccactgtaaccgctgcggaaaccaatctttttttcataccatgttttctccctattttcttttgttcagtctctgctataaaattgcataatagtcattatattccataaaaaatatttttacaaatcctaaaataaatatatctaataactagggtataaaacaataatttatcctgctgacattttctctgtcatacattataatttctataattttaaaaatcaggaggaccatataatgatcatacatgaaataacagaagaatgttttaagaaatatggaaaggtgatagactctatagatcttacagagctggtcagcacaatgcagacagtagaaattcctgctgatgtggtttatgagccatccatttctgcactcgaaaagctaaaatgcgctacagaattacaacagaaaacatacggggagcttcctatacagataggctggtgcataggcaacaatcataagctcaatgctgttgaatatcacagatgctctgaggtcaatattgccgcaactgatgccatactgatactcggccgacagcaggatatctccgtggaaaatacatatgatacctctttgatggaagctttcaggattccttccggaacagcagtcgagctttatgccacaacactgcactacgcaccatgtaatgcatctgctggcggatttctggtagccgttgtacttccaaaaggcacaaatgaagccctggaacatccacacaccggcggagaagatgctcttcttgcagctaaaaacaaatggctcatcggacatcctgaaggtggacttcctgatggatcatacatagggcttacaggtgaaaatctggaaattaaataaaaagcaaaaaacagcccgggctttcacccgggcaattattatattacgctttaactttacgataaaattaagcctttgcctcgtcctcgttgtctccccagaaatccaccggctcatagtcctgcagctttgcaaggaagcccttctgcttaagctcctcctgtatggcatcaagcacctcttcactctccgcacatattgtgtgatagtgataacctgaagttacatttttaagaagactggactttcctgtgcggatttcctccaggtaatttctgacatcacgtctggacttgatgtccatattggcgcggatcactccgtagaccttgtggtatacaaatacgtccttcacatggcctccggcatcaactatcgttgaaagctcctcctctacttcatcatcctcgtgaaccacctttaatactctcgaatactgcttatccgcctgtatcagatatcctctgtttgtcgaaaaaatcgcggctccgtttgctcgaagcagtgctatgtcctgcacaatcacctgacgactcacatcaagctcctttgcaagcgcaactcccgccacaggcgactttgacgaggatagaatatttattattttttttcttctctcatcaccgttcattttcgttcctttccgtaaaacattactgtcacagcatagtgagaccggcaatctaaaatctatactgcatgtagatttttaagtgataaatccataataggcgctgaatgtgtgagcgcaccacttgatacatagtctacaccaagaccctttattcttgcaatattttctttggtaacatttcccgaaacctcgatttcggctctgccgtcaatgtagtcgatgcactgctttaaaagctctgttgacatgttgtcgagcatgataatgtcggcaccggcttcaaccgcatccttcaccatatcaaagctctctacctcaacctcaatctttctgacaaacggagcatagtcctttgccatggcaattgcctcttttacgccgccagctgctccgatgtggttatccttaagaagcactccatccgagagattgtatctgtggttgtttccaccaccgactctgaccgagtatttttcaaaaattctattgtttggagttgtctttctggtatccaaaagcttgataccggtgccctctaagagtgctgcaacctgactggtatatgtggcaattccactcatgcgctgtaaataattgagcgcagttctctcaccgcacaagagtactctgatatctccgtaaaccttgccgataagctgcttattttctaccctatcgccatcctttacataaaactctacctttgtatctgcatcaagcagtgtgaaaactctctcaaaaacctgcagtccacagatgattccgtcctgtttgcagattaaatccacctctcctgcctgtggatgtggcatcacgctgtttgtggatacgtcctcgcttgtgatgtcctcctttaatgcgcttaatatgaatgggtctacgttgaggcccagtgttacctgatcgtacatatatttagattcctttcgttgcgttatttgcattttttagttttcttttatattacggtttcgcactttttatgcctgaatataggcaatgcctgattcgacaatctcttctgtacctacgctggtgcggccctctattgcctccatggcgagcttcctgtattctctctctacagctttttcatcgctgtagtctgcgaggtcgatgctatctgcggcctttttggctgctatctcatcatttacaaagccaagctccgccatctgtcctgctgcacgctttgcgaataccaggctctcaagcagtgaattgcttgcaagacggtttcttccgtgcactccgttgcatgcggtctctccaaccgcatagagacattccatggatgtgcggctgtggtgattcaccttgacgccgcccatgaaatagtgctgtgccggaacaacaggaataggctccttgaagacatcatatcccatctccttgcaatgttcaatgatatttggaaaatgtgatacaagctcatcccttggaatggtacgcaaatcctcccagacaaagtctgtgccgtcctttttcatctgctcacggattttgccggtcagcacgtctcttggtaagagctcatcgacaaacctgttcatattcttgtctaaaagcttagcaccctcacctcttacggactctgaaatgagaaagcttctgtcctcatgctttttcgtgtaaaaggtcgttgggtgaatctgcacatagtctgggtttttaagctctatgtcatgcttttttgcaatggcaagcgagtcacctgtcagatgtctgaaatttgttgaaaatctgtacagtcctccaactccgccacaggccatgacagtgtatgccgctgtcaccttttccagcgtgccatcctgttttctgatgatggcgccgtagcatttgttattcctttcgatgatatcaaccatcgtcgtatactccatgagtgtcacatttgaaagcttcttaacctgtgcaagcaatgtgcttgttatctcttttccggtcacatcctcatggaaaataattctgttgtgtgaatgagctccctctctcgtataggcaagtgagccgtcatcatttctcgcaaaatctgctccgtatgaaacgagatcctcaaccacctcaggtgatgagtttatcattatctcaaccgactccttgtcattctcgtagtggccggcctttaaggtatcctcaaaaaagctgtcgaaatcagactgctctttaagcatgcacatgccgccctgcgccagatatgaatcattgctctccagatctgattttgttatcagtgtaattcttacgtctcttggaagcttaagcgcacaataaagacctgagcagccgcttcccacaataagtacatctgtattcatagtatgttacctcttttatttacctgcatccaccgatgtagccgcttctttagcaacatccccctggatgcgatttactgtaatgggcgtattataacactaaaatttacaattgacaagacacctgtaaaacttttgtgttgacagctggtttacagctaagtataatgacaagtaacttatttattttggccggttctttatgtaaaatccaaaatgggcttacattgatacaactgtgcttcaatcacactaggaatttcaagaggtatatcatattatgatgacaacaagagaattacaggatgagattatccgattaaagaaggaaaatgatatctgtatattagctcacgcttatcagagtcacgagatacttgaggttgccgatttcacaggcgactcatatggactcagcaagcaggctgccacagcaccacagaagaatgtgctcatgtgcggtgtccgcttcatggctgagacctgcaagattttatctcctgacaagcatgtatttttgtcaaacagctcagccggctgtcctatggcggagcagctcgatgtagagctcttacaatcgttaaaggccgagaaccctgactatacagtggttgcctacataaacaccacatcagagcttaaaaccatatgcgatgtgtgcgtcacatcttcatccgctgtaaaaattgttaaaaatattgacaataacaagattcttttcatccctgactgcaatctgggcgcatgggttgaggaacaggttccggaaaagaccttcaaatttgtacatggtggctgtcctactcacctgcgcatgtcaatagcagatgttgagagagcaaaagcggctcatcctgctgcaaagcttctcgtacatccggagtgccttgctgaagtttcaaaggctgcagactatatcggaagcaccaccggcatcattgactatgctaaaaacagcacagacagggaatttatcatcggaactgaaaacagcatactgcagcacttacagtatgagtgccctgaaaagagcttctatccgctctcaaaagactgcgtatgccacaatatgaagctcactaccctgatggatgtatacaattgtgttaagggagcaggcggagaagaaatcatactgcctgacgatataagaacaaaggccaaggcctgcatagacaccatgctcacacttggagagtaatttaattgcaagttaaaagaccacagttcatctgttttgatgccctgtggtcttttttaattaattgatgataatacttcatctgaatatctttctttaattttcatttccagcacctgaaattcatgaatataactgtcaagcaccttattcacaagctgacgtgcagcttcctcattgtatatatgagttgtatcattcctgtctcttaacattccaagccagacactctcatcaataaaatcataatacgcatatgcagtttttataatttctcttggagaacctgttgcagcctgattagcgccctcatatcgtaacagttcctttaagaccttccagcccagctcaaattgtatataatatttatcaattataccgctcacaataaaatcatttgtcaagtcttcatcaaatgcccttgacaatatcctcaagtgtctgacatactggtcaaactttttcatacaataccctcccatccctttctatttctgtcaccagtaccggtgaaatatgcttatcatccatatttattatgtccagctttagtaaagaccacaactcctcattaagacaatccgataaatcaccaaaatcctcacatccataaatagccagatcaatatcacttttaggatgattcgtgcctctggcgcgtgaaccaaacagcactactttttttgtattatatttttttgctatattaacaatttgcttatatacttcatccatataatactccttatttcacatccgtctaattgaatccaacaaccttctgtgacagcttatacgcaccgatagctacctttctgcctcccttgcccggcaggttcattaactgtcccatgacgccatggcgcagcttcttgtaggtttcttcatcgtgctccttcatgtatgcccacagttcatccttcttagccatgttctcatcggtgcctgagataattgccagaatagtagaaatagtcgtaataatctccagataactgtacatatacttcctgcacatctcatttgttatctcatgcaatttgacatcgtcaaacataatcttatttacacgaatctgctggtcaatacggcgtatcatcacctgctcattgaccgactggtcatcgcgaccgataaaatatctgtagaagtccacatccagatagtacatcgtgcgcacatacggaagcggcttatatacatagatattatccacataaaaggtatgctttggcagcttgagtccacagcttctcaaaagctctgtcctgtatattaccgaatgcatcagtatgtaatgtcccttgtgaatatgctttatatcactccaggtaaatatctcattgcgtggaaagccggtctgacgcataacctttttacgccttgctccttctttctcgtagacatagttggcaagaagcatatcaatctgtgtattctcctgctcaaactcccttagcttgtccagtatcttcttgtatgattccaaatccacccagtcatcgctgtcaacgaccttgaaatatttgcctgtggcatttttgagacctgtgtttacagcctctccatgtccaccgttctcctggtgtacagcctttactatgtcaggatattcggctgcatatctgtcagctatcgctgctgtctcatcctttgaaccatcatcaacaataattatctccacatcatctccacccggcaggatagactctatacaatgctccatgtaatcctttgaattgtaacatgggattgcaaaacttaataatttcatctttttccccttgtaaaaaaaataatatcgctgtttgattatgcataaaatcttatcctatatgcaataacaaataccgatactataattatacacaaaatcatgatattgtctaaggattttttatggtaccttaggactgcacagtttgttcatattttgtttacagaaaagtgaaattcaaaacacacggttttcacaattgatttgtatactaacatcataaacgaaagatacaaaacaaaagcaacaaaacatattaattacgcaatactcatactaatctttttcatatatagccgatgcaagccacatgcatcggcttcctctttatatatcagcttctctttatcttacgtgaagccgtcttttcaaactcactctcccttactttaaggctatagatacgcttgtacgcaggtacatttacattgtactcatcaataagctcctgcagagattgtgcttctcgtgctcgtcgtaaagcttgacaatacactgattccgtccacaaaagaagagaccgaacagactatctcagagctcatctcactgcttgagaagggcactgataatcctgaggggtctctaaatttcctgcgtgtctaaggacactatttatgcttttttctaaaaaaatattggactattgctgccggaatgattcctcccgctaaaatcattccttttgaaagcgccggtgttttacgtacaacgtgaggtgacctttccttactgtatcctacatatataggcttttcttctttgtctttgtagtctgcctttatatatccgatagcgttatccctatccggtacatataccctgattatattatcacgcatatcaccattaaaagctttatatgctgccactatctcataatctgagtgatgcggcagatactcaaaaaaatactgtctattatcaacacaccataacaaaagccatattacaaataccataataagtgctctcatgtcttctttttcatttgaattttccatatccaaacacgcctcgattttcctgactcattctttgaaaagtgatacgcaccgatgaaaatatgtactgtggtgtcgctcaacagaaatacaatgctttagcttgattgtagcattaaaaccgcaaaagggcaataaaaatatcaggcaaattcctattatcctattataaaagagagacagccgcgaaaccgcaaaaacagccgggcacatctctcacatatgtctgactgttttttatcgcttactattcagttttattgtagctgtccgctaaattctcctatagtggtacgcaaagtatatattgccggcgattgcggtgagcgtccacgaaatgacgtatatgagatataaggactgcagtgtcttaaaatacgcaaacactgtgagcagccatataatcctgaatacgacagagcccataaccactatgatggtaggtgctacactttttccgatgcccctggcggcggctgtggcattgtccatgaatgctgatacacagtagacgaatgccatcacaccaattctgatctgtccatagtgtatcacggcatcatcactcgtaaagagcaaaaggaacggtctttggaatataaacaatgccactccaagcaccagtcccatcagaaacgagtatgccagggtgatgaaaaatgtgctaagcaccctttcctttttcctcgcgcccagattctgcgctatgaagctggtacatgcggtgtaaaatgctgccatcatgtcatagatgagcgaatccgcattggtggcggctgaattgccctccactaccacatggctgaaggaattgatggatgtctggatacatatattggctatggcaaagagcgagtactgtatcgcagccggcactccaatccgaagcactgctgcagctgcatccctgtcaatccctatgtccttcatgcgcaggccgtagctgccatatgtcttcaggagaaacctgatgatgagagccgctgagatgtactgtgctatgatgcttgcgatggctactcctatcactcccagtctgcatactattacaaaaaacaggttgagcactatattgataattcctgagatactcaggtatatgagaggtctctttgtatctcccactgcgctcagcacaccgttgccgaaattataaagcgcaagcgccggcgaaccgcacagatatatcatcagatatgctgtagcaccgtctataagctcaggctttgtattcatcacttcaagcagtggctttgaaaaagccatgcctgccactaacagtaaaagtcccgctataaagcacaggatgaccgatgtgtggacggtcttatgcaccctctgatagtcctctgctcccatgtgcagtgccgtgacagcattgacaccgcctcccatgccaagcagtatgcctgttgtgagtgtgatgatgatcgtcgtggaaccgaccgagccgagtgctcttgcacctgcaaattttcccaccactgccacatccgtcatattgaaaaatacctgaagcaggtttgagaacatgagcggtatggagtaaatcagtatcttccttgcgagtggtccgttcaccatatccagttctttggtctgtgttgctcttgacttcattttttcctcttgtaaatctataattatatattaacactgccatgtgaacagtactctaattatagatacgtttcgttcttttttcaagactgttgtttacgctttacaaaaaagattatataataaagtcaaaatgacttaaggggtaaaaaatgtttctctgctgcgtcacgatatgaggcactttctgaataatatagctgccttcatcgaaaacaatgaaaacgacaaggccttagctcataaacgatatgcccgttgcaacagaaagagggcatgggcttggtacaaaaagcatcagacagactgctgagagactgggcggcaaatgccagtacagtgtatctgatactatgtttatcgtgagagtaataatctaatctgattcatgcaaaatagccggtgcttaacacaccggctattttaattcatatacaataaataattcaaatcataatttagaaatctgtgaggtttgcagctctcttctcaaggaatgctcccattccctctttcttgtcgtttgtatcatttacaacaccaaagaggtttgcttccatctcaacagcgttcttgatatccatatcatatccgttgttgatagcagcctttgcaactgagattgcgtagcttcccttagagatgatctttgcagccatagccttagctgttggcataagctcctcttttgctactaccttattaacgagaccgatgcggtatgcttctgcagcgtctacattgtcgcatgtgaagatcatttccttagcacgtcccattcctactaaacgagcaagtctctgtgtaccaccaaagccagggatgattccaagtcctgtctcaggctgtccgaaaattgcgttctcagaagcgattctgatatcacacgccatagaaatctcgcatcctccaccgagtgcgaatccattgacagctgcgattgttacctgacgcatattcatgagcttgaagaatggctctgaagccttgattccgaatgctcttgcctgtggtgctgtgaaattaaccatctctgagatgtctgctcctgctacgaatgacttgaactcgttgcccttcttgtcaggaccacctgtaaggataagcaccttaacatcgtctcttgcctctatctctgttaatgctacatttaactcatcaagagtctcactgtttaatgcattaagagcagccggtcttgaaattgcaagtactgcaatctgatctgctacgtcaagtgttaaatttttgaactcgctcattgtataaatcctccttaaaaaacctatgtatagccgacatttctgtcgtaatttataaaaaaatagtaacactttgacaaatttttgtcaatgtctgaatgacctttttcaataatatttaccgtttaatttaatatacaaaatttaaggagacagtctgcttaatgcaaactgcctcccgccttagaaataatataatcaaattatttaattaaattaaatcaaaactcaaattacataagtccatgtgtcctgttgtaagcattgcagatcatatttgagttcttgataaggatatgcatagcgatgaatggtccgattccacagataagtgtaccaaatatgcaccacatcaaaacagtggttccattctcctgaatgccaagtccgtatctgcctgcattatttgccagtctgttgcccagcttatagtaccagtaccatgcataaataccgcatgtaatcattgaaagcaggataaatgctacgagacctgatgtattctcgccatctccatcacatgctacattgacatcatgagccatcttgtagatgaaataatatccataaataccacatgtaataatagacagaatgatgtatgaggcaagacctctgtcatcctttaacttctctcccctgtatggtggaggagtctgaccaccattgttctggtagcctgtattgtactgtccggctccgttattctggtagcctgcgttgtactgtccggctccgttattctgataacctgcgttgtactgtccggctccgttgttctggtagcctccattgtactgtccacctgcattctgctggtttgcactgtttcctgtgaaggactgctttacctcatcaaatgcacttccaagctcctgctctgctgcattgaaggcttctcctgctttgttgacaaaatcctgtgccttcgaaacaggtgctccacagtatggacagaattttgttgaatcaggaatttcttttccacatttctcacaaaacatcttctttctcctttttatttgctatttattatacggatgatacgaaacaggatgttgttttgcggctcaaaaaccactacatcatcgcctgaccatatcaatctacacatataaactatagcaaacataatgatgattgtaaatataattattttataaattttaatatttattttagatttacacaaaagcactattaccgcaataggcacaagccagaaaagcggatggtattcaaatgcctttgctatatcaagctgtaaaaatgccatccatgccctcgacatgccacagcctgcacatgatattccggtgatgaacttaatggggcatgtgatgcctatcaactccatagctgtgtaaagtaccactacggctgtgacagcacatatgagctcttttctttcattttttcttttattatttcttttattgtccatacaaatgttatctcaaaaagtatgcactgtaaggtggcagctcaaggccaccgtttaatgtaacctgctcacctgtaatcaggtctgttgcatcaccctttcccatatcaaagcccgcgaaaaacggctggtctgcggcattgatgcacacgaataccttttcgccatcacattcacgaccgaaaacgcactggccgtttgtgagcacaaccgaatagaaattaccgtagcagagtgcctttgactgcttctttgcctctgcgagctttgaaatccattcagtcagctcattgtactgtggtgcttcaaagcatgccctcagagccgggtcaccgtcttctttttttgccttctctccccactcactgccatagtacacacaagggatgccaggcataccaaatgcaattgcatagattagtggcagatgcttttcattggtcagtatgcttgccactcttgtcacatcatgattgtccacaaatgacaggaggtgcttacccttgtagagagtccactgctccggtccgaactgtctgagaagcgaatgatttatctcaaacatattcatggaattaaagctcgagtacagacccttatagcactcatagttcgttaccgagtgaagcatcgcatcattcataatctggttgtagtcaccatgcagtgtctctcccaccaggaagaaatccggctttagtgagtcgcagaactcccttagtcttctgaggaaatcatggtcgaggcagtatgccacatcaagtctcagcccgtctatatcaaactcgtctacccagccctttatcgctgaaaagatatgctggattacatcctcatttctcagattaagcttgaccagatcatagtttccttcccagccctcgtaccacaatccatcattatagtttgagttgccgtcaaaggctatacggccaaaccagtttacatatggtgagctttctctgtttttaagcacatcctgaaatgcccagaagcctcttcccacatgattgaacacaccatccagcactacctttatgccgtccttgtgcagattgtcacaaacctgtgcgaagtcctcgtttgtgccaagccttgtgtctatttttgtataatcccttgtattatatccgtgtgtatcagattcaaacaccggtgaaaaatagattgcatctgccccaagctttttgatatgaggtatccagtcattcactttcaaaattctgtgctccaaaacaccatcattctcaaatggtgctccacagaagcctaacggataaatctgataaaatacactttcatatgcccacattattttgccctccttgatagttgtgtagtggttttgtacctgttatctgttatctattatacacaattatgtacttatatgctacattttttgttactttttacctacattaagtattttgttacctagtataattaaatttctaatagaaattcctgtagataacacatgcaataaccacatggataaagaaaataagcggcatcccctttacaaaataccaatgctttgtcttgtgcctgaaggcatacatcccagcccaggtaccggcgcttccgcccagcaggctgagcccaaataatgtcttctccgggatgcgccatgcgtgtgccttggccttacacttgtcaattcccatcgcagcaaagcctgctatattcataagaagcagataaatcagaaaaattttcatataaataatgctccattctattactccgcacataaatttataaatatataaacatatctgcatatattaataagtccacaaaaaacaatagcccagcctttaaaggccgggccataaattaattattaattcttagcttttttagaaaccttagccggtgcagccgcctgctttttgatggcgctcttgcccagataaagcttcataacataccacagctctgtagcgatgcagattgaagaatatgttccgcaaagcacacctaccatgagtggtaatgagaactctctgattgatgtatgaccaaagataaagagtaacaataccataacaaatgtagtaagcgaagtattgatgcttcgtgaaagtgtctgtgtaagggactcgtttgctatatcagcaagctcatctgctgagtacttcttgataccgtgaaggttctcacggatacggtcaaagataacgattgtatcgttgactgagtaacctacgattgtaagtatacatgcgataaacgtactgccgactgagattctgataagtgcatatgctgtgactacaacaagcacatcatgtaccagcgcaaggatagcacttgaagcaaatctgatgtccttgaatctgaaccagatatataacagcatgaaaatacatgaaataataactgcctttacagcgtttgttctcatctctccactgattgttgagctgatactctgagtctctatagttgatgcatcaacattgaaatccttctcaagaagagctgcgagatcctgtctctcatcgagtgaaagtgtacgtgtctttaatgtgacatcatggctgccctggactgtagtaacctgcactgcactattgccaaggagctttgatactgaaggcacgatgtccttctcaacctctgcggctgtataatccttgccaaagtctgctgtggttgatgtaccacctacgaactcaaggctgtagtttaatgcattgccacttgtagcaccgaaataaatcatgccgccgatacctgcaagtataactacacctgagataacaaagtatttgactctgttctgtacaaatctgataacctttctcttctttgccttgccgtagaacttctcagctctgacaccgacaccgtaaaatgctcttgtaaggtattttgcgataaaaagagctgtaaacagtgacagaataatcgaaatcataagtgtgtatgcaaagccctttactgtacctgaaccgagcaccataagcacaagtgctgcgataaaggttgtaacctgtccatcgaggatggctgaaagagccttcttgtagccctcatttactgcagcaagcactgatttgccacctgcgatttcctcacggatacgggcaaatacgataacgtttgcatctactgccataccgataccaaggatgatacccgcgatacccggcagtgtaagtgtaatctcaaaccagtaaataaacagtactgtaagcattgagtagagtgcaagtccgatagatgcaaccacaccgagtataccatagagcacaatcatgaatatcatgattaagataattccgataattgcagcctttactgcatttgtgagcgctgttccaccgagctgtgcaccaacaacatttgactctaactcctcgagctggaggttgatggctccgacacggataaatgttgcaaggcttgttgcctcgtcgtaatccttcattccgttgattacacagttaccatctgagataacggcgcttactgtaggaacgctgatgaaatgatcatcatagtatataccgattgactgtcctgcatcctttgccttctttgtggcatctgcccatgtgtcaatagccttatccttgagctttaatgaaacaacaggctccttggttgatgtagatgatgactggtcatactgggcgcttgcatcctttacatcgttaccatcgaggatgactgaaccattggcctttaaggtgtcaatatcatagttgagcttgtagccgccctgggccgatgtgtcctgtgtatagttggcatttccgtcactgtcatactgggcgatgaagtacagtgatcccggacttccaagatcctcgagtaccttgttagggtcgtcaacacccggaatctctacagtgatacggtcatccccgctcttgtatacagagtactctgttgtgtagctctctgcacgctcctcgagctttgcgatagtatcatttacatccttgtctgaaggattcttgtccttgatatggtaggtgattgaaacaccacctgagaggtcgagaccaagcttgatattctgataatccttatccttggtgctctcaccattagcagttgcctcctgcttttgctttgtgtcggtgattactgcagtggaataccagcccagcaagccgatacaaatgactgccacaaggataatcacccaactctttccttttttcattttcttataccttcctgtcattttgctaccatccatataagtatacagatggcaaatatattcgcacacgggtcacaaataccgctatccgtttcccgtgacaaattcaaattattgtgcatcatctgcaatatcagcctctgctgccttaatcatgatagcgcactctatacgcttcttctgcagctcgcagcctaaatcataggcatcagtgattgtgccgtggaagttgtatgagttggcggcacagccaccgctgcaatagaatctggcaaaacagttgcgacatttttccttggcataaacattacagcacttaaactcatcctggatgtcagtggccttgatgccatcccagacattacccataaggaagtcctcattgcccacaaactggtggcatggatataaatctccccatggagtcactgccaggtactcagttcctgagccacaaccggaaaggcgcttatatacacaaggtcctccctctaaatctatcataaaatggaagaaattgaagccgtttcctgccttgtttctctttaccatctctgctgcaagtctgtcgtactcatcaaagagcacaggtaaatcagattccttaagtgcatactcatctgtaggctgtgccaccacaggctcaaccgaaatctgtttgaagcctaaatcagccagatgaagcacatcctttgaaaaatcagtattgaaatgtgtgtatgtacctctcacatagtacttgtcctgatgtctgctctctgcaaacttctggaatttcggaacaataaggtcataactgccggcaccctttctgaaaggtctcatacggtcatgaacctccttgcgtccgtctatactaagaactacattatccatctctttgttggcgaactccataatctcgtcatttaagagcacaccgtttgtggtgagtgtgaacctgaaatgcttgtcatgaagcttctcctgctctcttccatatgccacaagctgcttcaccacatcccagttcatgagaggctctcctccaaagaagtctacctctaagtttcttctgctgcctgaattggcaatcaggaaatcaagtgcctgttttcctgtctcgtagctcatgagagctcgtctgccgtgatactcgccctcctctgcaaaacaatatctgcaggcaaggttgcagtcgtgcgcgatgtgaaggcaaagtgcctttacaactgtctggcgcttcttgaaatctatgatacgctctttgtatgtatcttctgtgaagagctcttcattatccttaagctcatttacttcctgtattgcttcttctatctccgtctgtggatacctgtccacaagcttttcaataatctccttagctgagttgtcctcaaacagctcaataacgtcatatgtgacatcatccaccacatggattgcgccactgttgacatctaagacaatattatagccgttgttcttgtactgatgaaccactacaatattcctctctttctatacacattttaaaaatacactgcgaaaagagtgtgcacctatcagcgcacactctttaaatccgcttcacctatgactatttgtactgctcacaagtctggtttccaactgtacaagatgtcttgcaagctgactggcatgatgtctggcactcgccacatccgccctttttaacagtgttctgtaattttcttgtatttaatgtctttacgtgtttcatttttatctccttttcatttaacgatgtctcattgacacatcatatttgctttcaacattatatcacagcattatcaatatgaaaagtccttttttagcgaaaaacaagcgctgaaaacattaccagaaggagtattatcaaaagctcgaaaatatttttggattcacctatatctatgaccactgttgctatcacatacgttatccagtatgctacgaccgtcaccctgataaaacgtctgcggtgaaagcagcatttgagcaaaaatccgcacacaagccccaccactatattgaccgccatggcaagtgcaaactttatccactccgccatgtcgacaaagcactgtactatagaaagtatgataaggcacaaaagcgccgtaagatgcataatacatattgttatcacaggacctttgatttttctccacataaaaacgccctccacacatcatatatatgtgcaaagggcggtaattattcatatatgaaattcattcgtgattacagctcacagttattaactgttctagggaatgggataacgtcacggatattgcccatgccggtaagatacattacgcatctctcaaagcccagtccaaagcctgcgtgtcttgcagagccgtattttcttaagtcaaggtagaacttgtagtcatcctctgaaagtccaagctcatttattctggcaagaagcttatcgtagtcatcctctctctggcttccaccgatgatttctccgattcccggtacaagacagtcaactgctgcaacggtctttccgtcgtcattcagcttcatgtagaaggcctttatctccttcggataatctgtgacaaatacagggcgcttgtaaatctgctctgtaaggtatctctcatgctctgtctgtaaatcacagccccatgataccttgtaatcaaacttgtcattgtgctttgaaaggatgtcgatagcctctgtgtatgtcacacgggcaaaatcattttcaacaacatttcttaatctgtcaaggagtcccttgtccacgaaattgttgaaaaatgccatctcctcaggtgcattttcaagcacatagctgataacatacttgagcatgctctctgcaagcatcatatcatcctcaaggtctgcaaaagcaatctcaggctcaatcatccagaactctgccgcgtgacgtgtggtgtttgaattctccgcacggaaggtaggtccgaaggtgtagatattcttgaatgccatagcatatgtctcgccgtttaactgtcctgaaacagtaaggttggtaggcttattaaagaaatcctttgagaaatccacctttccttcctctgtcatagggagattgttcaaatcaagtgtggtcacctggaacatctctcctgcaccctcacagtcacttcctgtgataagcggtgtgtgcacgtacacaaaatccctctcctggaagaatttgtgaatagcatatgcgcagagtgagcgcaccctgaaaactgcctcaaaagtatttgtacgaggtcttaagtgtgagattgtacgaagatactcaaatgtatgtctcttcttctgcagaggataatccggtgtggatgccccctcaacagtcacctctgcggcttgaatctcaaatggctgctttgcatccggagtaagcacaagtgtacctcttacgataattgcagctccgacattgatcttgccaacctcatcatagttgtctaatccatttccgtatacaacctggattggctcaaaaaatgtaccatcgtttaccacgataaatccaaaattctttgaattacgattgcttctgacccatcctccgatagtcacctctttgtcagcgaatttgtccttgttgcggaaaatctcgcgtatgtttgtaagttccattatctaatcctccatttaagctgcctgcgcatcaccacagacagcatatttatcgttattattcggcatccgcgctgccacttgaagtatccggcgctgcactgccatcctcaaatgtcacatttgctttctctgtgactgtatcaatagccttgtttacaaggtactggttcttaaggtatgtctttccctcatccttgtgtccgcttccaaaatacttgtatacctcagaagccttgctgaactggccattgctggctgatacgatgtaatccacatagctgttgaaggcatcatcatccatcttgatattttccttctcagcgataagcccaaagatgaactctgtctttatctggtctgtcagattctccttccacttctctgtggcctgatccactgtcatgttgtagttggactttaaatatttcttaagtgtctgtccatccttgacattttccttggtaaatgaagcaatatactcattgagtctggcctgtagatactcatcaggaatctcaactgtgctgttgtcaatcatgtagctctttatcttgtccacctcagcgctgtagagctgctgcttcaaatctttctcaatctgtgtggtaagctgggcatttgttgtcactccggcctttccaaacactgtgttgacctgctcgtctgtcatatcagcaagtgcaacaggatctgctgagtaaataccctttactgtatactcaaatgtaactgtctgtccgtttaggtcatcgttgccataatcctcagggaaagtcacgtcacccttaaccttgtcacccaccttggctccgattataggctttgtaaatccatcaataaaggatgaaccgccgacctggctgttgtttgtcacatcaagcatcacatctgtagctgagccaccatcaaatgctttgccatccttatatcctgtgtaatcaaccttgacataatcgccatctgcaactgtatcacgatctgtaacctgcttgtacgcatctgcaccatatgactgaagcacattggtcagatatttctgctttgctgtatcgtttatctcataatcgtttgagacagtaattgcaacacctgaatagtctgcaagctttgtaacctgctttgcgtagtctatgtcaaactgtccgcttcgcatcgtctcgctgccggcctcggtgccagactctgttgcgctctttgagccaccctttttgctcttgccgcttatcacagcaacaagcgcaataattaccacgataagtgcaatcacaatcactgctatgactgccttcttacctgtattcttcttctcactcattggaatcctcctgaaatctgtaagtcatgttatttataagtacaatgccctgccacggcaaaaacgcatccgcaaaacactatacctgtctacaatatcacatatcaggttaaattacaacgagtgaaattttctttatctttgcaaacaccggaggagtatgcattctaagccctactgtcaccctggcattcttttgcagccttaccggcttaagcagatgtgtcacaaacctgatatcatcggggaaaatgtcgcttgtatatgtatgaacgccgctttcatcctccacatccataaacagctcgacctcgacacctgttgtattggttcctctatagtcaaccgctgctatatactcaccggtatattcaatatccaccgtctggcttatcgaatagtcaaaattggcatctgaagagataaacactccatccttacccagtgtatactgtccttcttcgaggcttgtctcaatctgccaattattaaatccatccttgaattcaggatttgagattagatttccatgaatcataagaagcttcatgaaatcctccacctccggtgtttcttcatactcataaagtgattcaatatacttgtcaagctctttaatcggcggatttttcggatcaaagtccctgattgcatcccagcccggcaaagccctgccatgctcgtcaaacatgcccatattctcaaaccaggttcccatgcctttaccaggcacaccgacaggctcccagtagtatacacctgtctttccggtatcctttgacacctctgctgctatctgcatgattatttcaagagacttcttctgctctgcgctgcctgcatcaaggcctgcagtctccataagttccttcgagatatgatctcccttgcaatgcctccacggatgagctgtctccacaatataaaccggcagattatataattttatgagcctgctcatagtatccttcaaatccatgaaggtaccatgccagaacgaataaaaggaaaggccaatcgcgtcaatcggcagcatgcccgcattaaacatagaatcaaaccaaggcataatacagttatatctgcctccctgatccagatgaatcatgacctttgtctccgggagcagctccctgacagctctgattccctcatttacaagcgcagccagctgcctgtactgtggcactgcaccatccggaaacagcataccactccttatttcattgccaatctgaaccatatccggcacacaatccatgatttttaatctgtatagcacatcatatgtgtacttgtgcactgcctccttcagctcatcaaagcttaaattcttccacgcatcaggcttattctgctgtcccggatctgcccagtaatctgaataatgaaaatcaagcagaaaatgcattttgtattttttaatgatatgagccatctcgagaacatatgtaagactgcaataccccttagactccggcaccttatcaggctcattccatatgcgcagacggactgaatttacattattcagctttaaaaaatcaaataccctgcacacatgaccttccctgtccattatttgtatattattgtcaaccatcataggaacggatgaaatatccactccctttaagaaattgctatcctttttctgcttgcgctgctgcttaagctgatacatctttgtgtcagcacttactagataatcgtcaaagctcttaccactgcccggcctcgtatatatgatgccgtgactgataaacaggctgtgctgctccatgatatcatacacgcgctttatatacttctcagcagtgtcatgtctgtccccggggataaacacgataaattcatctccaccgaatctatataccatacttccctcaggcttttgctcatcaagcaccctcgccacagtctttaaaagctcgtcaccgtactggtgtccgtaggtatcatttatgtccttgaaatcatccacatcgagaaatactatggtgcagccgacattttgagcttcaagctcagcaaacataggaatcaccatctcattgcatgccacacgattgtataggcctgtgagcacatcatggttgtagagattcttaagctcattatttgtattctcaagtaccttttgcttaaaaagattctcaagcctcttgagcagggcagactgtatatcaaactgctcaggatggtcgtacaaaaactcaggattcctgagtattacatagcccactatctcgtcccggaaatgcagcgagcaatacatatagcaggtgtttttatctacactctgcatgtactgcataaggtcatttacactcttaaactcaagctttccattgtccttgtcatccgcatagagtacaacctcgtcgtcaatatcatagccatgcttcctaaagtgtgcattgttccttgcagctgccagatcagaaacaccgaccacatacactccgtcacacttcatgctctgtatatagtcagagtatctctcaaacaaatcatagtattcattacactcctcgagctctttctggaggatcattactgcatcctcctcctgttcttttgcaacggagcctttgataatatcctttatgtaattacgataatccactctgccggtattagggcatccgcagctctcagccgggataaactcagaatcaaggtatttatcagaagcatcgcccgtgccattccaaagcgccttaaatatctcaagagcatttctgcctatattgcccctgttgttatccactgttgtaatctgtgggttaaaatacgcagccttatccagattgtcaaagcctgtgaccttaaaatcctgtggtaccttgtatccaagaacctctgctgtcgcacacagtcctgctgctatattgtcatttgcacataaaaagacatccggtaacggctttttgctctcgtgccaatcactcatatacctgacacctgtctgataatcaaaatcaccaaacatgtacatatcagctgtaagtggtatgccataatcacttaaagcctccttgaaggcctcaaaacgcattctgttctcataatgatacggcggaccacctgcaaacacaaagcttttgcagccatgcgcatagtacatatgatccattaccttgcgaaacagcctcttattatcgttgcctacatagtaaaacccatcaaccttatacccgatactcactaccggcacatttaccgactgaagctttctgaccatatactgtatctcatccaggttggtcgtattggtgcagtcaaataccactccgtcgaagctgtttaaatcaggcaaatcgttcagcgcatattcgcctttgttaaactttgaatcctgactccaggttccgttggtgttgtaaaaatacaggcacacatccagtcccagctctttagagcctcccatgataccctcaacccacgaatatattacatatcttctccagccatcagccagaagagcaattttcttcattaataaatacccctttgcgtcttctaaagagttttccaaaatatagttctattatactacggttttacctattcttgcaataaagattgattttttttagcatatttgatagaattaatttaaataagcaaatttttaggagggatacgttttgaatccagcattaatcgtacttattgttatcgcagtagtgcttgtggtagcatttatagtattaacaatcctcggtaaaaaagcacaaaaaagaaaggaagagcaggacgaacagatagctgctgcatcacagacagtcaatatgctaatcattgacaaaaagcgtatgaagctaaaggatgccggtctcccacagcagattattgagcagacaccaaagcttatgcgccgctcaaagcttcctgtagtcaaggccaaggtcggaccaagagtcatgtctcttatcgcagacgagcagatctttgatgagattcctttaaagaaagaggtcaaggcttctgtcagcggtatctacatcacagctgtccgcggtatcagaggacctcttgagaagcctaagaagaaaaaaggcttccgtgcaagaatggcagaaaactacagcaaggccaacgaacagctcaaggctgaggaggctgcaaaggctgaaagaaaagctgctaaagaggcagccaaaaaggctaagcagaaataatatcatgatttaattttcatgtacataaacagagcatgtgggatggctttcatcctcacatgctctgttttttatatgctttatccatatatgctttatatattttttaccccatagacttggcagacttttatgcaattttgactgctgcgccttttttcttcacagctatattgatgtgacagtcgcctacaaattcatagttgacatcaagtgcatactttacctctgcccttatctcgtcctcagtctcctttacctctatgcttgtggcatcaatacctatctggatacttccaaacggtgtataataatatgtcaggtttttctttcccttctcaaatatcatatgtacactcataggtcccttgcgggtgaactcaagataattgtcattgaatttaagcatatttttgagtgtctgggtctcaccctccattatctcctcaaaaagcacatagtgtttgttatttcttatataatactctcccggggcaatcacctctaccgcatccgactgctgatccggtgcgagctgcaggccctttaatgatactactacatcctttgtcatttctttctccttatcctcttgcatatctaaattaattcacgctttaataatttctcatcacatattttcttttaatatattttttcagcatgaatatactaactgttttatctgaaaatatcaaggatttttagttttatttcatattttccactgtcaaatatgctctcatactcgtccggagtgagtacctccttaagattttcctttgcttcgtcctccaccacctcgtacacactgcccctaaagcacatgtttggatacagcacgcaccaccagttatgaccggctccatcgcccagtgttatttcaagcgcctcgtaatttccctcaggaaatgtatagtccccatacgtcttttccgggaaatcggtgtgtgtaagctctgccgatgcgccatatgaaaaaccgtttgctgcaagcgtctcctttgataccgctattatttcgtccatatggtcatttacggtggctctggtttcttcgatattttcgcactccagcagatatggctctatgtaagcccctactgcatcgcgcacctgctttttcacattctggtctgcttcgctgtcgctgtttgccagcacgtggaaacgcaggattttgccggcgatggatttttgcatgtcggctgtacacgctatactattggtgtttgcggcaggtgtatgattttttgcagctatcgctgccgtaagggatattattgctatggttgttattattattttctttctcatgtaaacaagtattgccttatttgaaaagattattcatcctttttgaaatttttaccatgctccatgagtttcattcgtatagtcatccaataaggtgccaagtgtaattatcggttccccatcctcatgattctccttattcattttctgctcataataatcacccatgttatcaaagatatcgtttatatcatctgctatgcacacatatgtgtttctcggaaattttttggatgtcttgcagtattccatgaagcttgcataagctgctttatcatttctaagcgtttttcctattaatatcaccttcagatgattggtatcggctttttgtgacagccgctcctcgaagctgtccacggctgttttgatatcatctgcatattcgggctcataggatttgtccatgttataataaaactctatatatccgctactttcatttgccaaatcatctctgtggctaacatattctttgtaatcagttacatctttacctgttacttctttatcggttatttcgtcagtatctacagctacaacatccaccgcagcaagtgtcggaaagcaacgctcctcaagctccactgcactacagccggtaagcatgagacctatcgtcagcactactatgaccggtatcgctatgcacattaaaaatccaagatattttttcacgatttcatctccactttcaagaatatatgctaaggtcactgtgactgctatgacaaaaatgatgcaccagcttctcatagtgctcttttccttgtcatggcttttctgtctgtcagagccaaattgcttattgctacaggaatgccggtttttattaaatgtaaatataatttttctcgtattttcagcaaaattctcacatcttaaaaccgcataataaaggctcatattgagtactgaaaacagcgtgaaaaaccacaccgacagcatcagtgcatctgccctcttgaagaagctgccttttatctgcacatcactcatcagtacgacagctggaaactctatttccgacagtgaatattttccaaagtttccaagcaatactgcatacaataaaaaaagaatgcctgcatatgtgagtattgctttactcacactccatcgtatctgtgaggcagtgcgctcccttacaaacagtatattgaacacggaaatggatgctgcaaacacatagtatgcgcccgcaaatatatccgctatgccaaagtccacaccgactctgtccttaatcatcagatagtctaatctcacatccgatagcgcaaacaaaagcatagcagcaagcggtatcagcacaaagaaaaatactacctcgtataccctggcacggcactccactccgccacttagcgcataagcgcacactgccattatcacaagaagtacaactgtaaatgactcatccggtataaggctgtcacgtatcagctttacaaatatccatgcaagaaatgcggcctgtgacagttcgtatatcacaataattaaatcataaattaacatttttgcatgtgttgttttaccaaagcttctgtcatatatacttttcttctgttctcgtacctcgcttactatccacataaatagccatgccatgaaaacaccaagtgcgattgagataaaagcatactttccaagcttcgccagattgtttggaagcaccagtgtgccgactccaagcagattaaagacgtatagcctgtatagctggcggggcgatatgctttcgttttgtgcaaatgtatctcttttacccatatttatagccatactttaattcctttcaaagtaaagtatggctataaaatacaattaatatacaattcttaatctatcatttttatcctggtatcccctattcctcttttatgtcaatattctgcaccttatcctcacttatgaatatctttgcatttggaaatgccttacacaggctttctacctcagtttcatcttttgacaaaggggtatcatatatgcatatcgtttccagattctttagcgattttagatcatctgcatcttttatattgctaccccataagtatatttcttttacctttgaacaatttttgagaaaaccgaaatcactaactgtactatcgtaaatcttaataactttcatattgcagcattttgctaaaaaatcaaaatttgaaatattacagttttccaaataatttgaaaaagaaaaaatttctattcttttcaaacttgggactatatctgataattctttttgatacttttgtgcctgctcatataataaaaaatcaatgtcttcctctttttttaatggcttccatttatcgcctccaccatttattgttaatatcctcaaatttttacaaagttttatatcttctaaagtatcatactttcctggaaaacctatattcaattcctttatagcatatacatctttatattttacattctctggattaacgtttggtccaattgttctgcttatctcatatgccatgttggagtctttaaattttacatgacgattcatgtatatatatccaagtatcaccacgaatattaccacaagtattaccaacattatatatagattattcttttttttataaaaattttttatcataccactattccccctcattataattttcaatcacattaaaaatcaaaggatctctattcattatttttatactatttagaataatatatatatcttcatattttttagttttattaaaccaagacatatttatcccatctttaggatatccaatttcaatcgcaaaatctctatgctctttcatgtacttattataggattcaacaatctttttcgtttccggtcctggatataaatatatcttacacgtctctggattttcatttacatcatttgcaacacatattagtccaaattcatcaacaatccaaccaatgtgattggcaaattcactcaccgatattgtttccgctgtttctaatttactctcactattatcacaaatatcacaaactgacgatataatcccagaccccgggattttaccaattagcgaagatgttatctgatttactacactatccgacagcgtaccaagcatatttgtatttttatcaactcctgcatttgcccttatgtactttatccctttgttcgcaagatcatcctgtcctccctgatcaaatccagcaaatgaagtggtcattacttttttattgttgacttctccttctattattgttggctgtgaaaaatatggataatacacagcagtcaaatctccggctttattatttttaatatcaataagattagaatttaactcttttatagtaccatccagctttatttctcttaccataaccaggtctttatttttaccaaactctttaaaaaaagtattatactgtgctgctgtagaaatccatctatttctttcatcactttctgatgtatatcctattgcaatccatatttgtgtaaccctgtttatagctgcagataacccattatattttttatttaaagagtaccaatacttttctgtctttccttcaataccattatcaaaaacaacaggatttctttctccgttctttggtttcttaatcgtatagcaatctaccagaatttcctctaaaatgtcggcatcaccatttttaataatatattccgcaatcatattgtattcttcatctgatatgtcatcggcatctttatctaatatatttttccaatttactcctattatattctctgtttcctttggaagcgaatttataaatccatcttttgaaaagttattctcaaaattcacatctgaaattgactcttttaatttattaattatagtatcaaaatctgtcatcctatcattaaaatctctaaatattgttgcataagtttcatcaacattaattacatccctaaaaatatcatcaatcttttttgctgtataattctcaaaatctgatatatctcttagatagctttgaaaatttgacaaatcatcttcaagttcaagcgaattaaaaaaattcgatatatttaatggtatatcgctaaaaaaatccagtatctcaccatcatctgaaactcctgactgcaacgcatcataagcctcctgtgtaaattttcttattcgtcccattttattttacttctccttttatctgttcagcacatctctggtctgtatcttcaaaattaccatttatttttacgataaaatcagccgttgcctgtataagaccttgtaaatccgtctttacattttcaattatcttttctccctcttgtatggcagtgtaggccatgccttcatcaccttcctgcttactttttgaaatattaacttcatttatttcatttatcaattcctgtaagtcgttaacagcttcatcaataccatttctatcaatttgtaaaacattgctcataacatattctccttagtaaatttctctgtctgcctcatcaatatcctgtataaatttttgcatattgcttttattgttatcgcacaaaactcctgctgtcttaaatagtaacatgcttgcagtgtccgcaaaactatataatttttcggcagtaagtcctttcatacttccatcatctataatcccttttaatattccgatatatttaataataatatcatctatctgttttcccacctccatatatgcctgtgaatactctcctatataattatcatcaataataattatatttctacttcccaaaggattcataactgccactatcccaacctcctcagttcatactttaagatttgtcttttatacattattgaagaaatcatgtcatatttttcttctaacatattttcattattaagaatctctttgtccatctgtttcatcatattcaataatctattactgttaacattataacaattgccagatactcgatcgctcattcttcctacatatctttcaactagcttaacattctgtattaaacatgacatattctctaattttatcttttttttctgccttttgatttcatacttatcgcattcactctcaaaacgtttttgcgtgcacttttgattttttatgatttcttcaagattttcagcctgtgatctgagtttaactatatcattgtcacaggcaattatactttttcttatttcttcttttcttttttgttccataacctctctccctttcgcgcaaattcatacataatatatatgttatcatttgtattgtttaattacaataatacaattttaccattttcatcaacttattttgtccgattttctttcagcttcctgcactccttttctcttgcaaatacaggccgcctccaaagtcttcgaagcggaaatcgtatgatactgtccttttcatcctcgccgcctgtcagctcgctgcccacgaatggcatcatgtatggataaccacagcttttgagctttgcaagatgcaaaagtatcaccatcagacttattaaaaatccaaagtatccaagccatgccgacataattattacagcgaatttgagtatcctaaatgaaaatgcaaactcctcactcggtatggcaaacgagcagagtgcggtgaatgcaaccaggatgaccactatagggctcactaaatttgcatccactgctgcctgtccgattatgaggcctccgactatgcctatcgtatttcccatggctccgggaagtcttatgccggcttcgcgaagcagttcaaaggacagctccatcatgagcacctctatgagctgtggaaacgggcagccgagtcttgcttcataaaacgccagtatgagtggtgtcggcagtatctgtgtatgaaaatttgtgaccgccagataaagccccggcaatgtaaatgacataaaggctgccacgtaccttatcaatctggcaaagcttgccgctatcgttctgttatagtaatcatctgcggtttttaaaaaattgttcatggtggttggcagtattattgctatcggtgaattatcgcacagcaccaccaccctcccctctaggagcgcatttaccgccacatccggccgctttgtggtctgaagctgtgggaacggtgaataccattttgcctcagcaaactgttcaagaactcccgagtcacccacatggtctatcacatagctgtccagattcttttccacttcctctacaagccccagttttacgaggtctctcacatacaatatgtccacattgctgtgtccgcgaagcccctttttcacctctttacactttaagcgagtgctccttaacctgcgcctgataagtgcagtatttatctttattgaatcagcaaagccctcatttgagcctcttatgaccttttccgaatcaatctcctgaattgacatggcgggatatcccttgtctggaagcttgaaggcatccggatagccatccacaaaaaaaatcacgtctcctgtcagcatcatctgggctgcctcattaaccgtgtgcagatgtgcaaattcggatagagctgcctgatttttgtcaagtacttccttaacctgatcccggtctatcccttcaaggtatgatgtaaatcgtccaaacgcactgttattgataccagagcctgcacatgtcacctcaatatatgcaacaaaacactttatggaagcatcacgccccagatacatctcctgcatcttgatatctgagcagtcagaatatatctgcctgaagctttttatgttctcatctatgtttgtggtcatctttaactctcctatatacccaataaatcccgtaagatttaaaatccctgatatagtatgaccatacaagcccgcaaatatccctgattacttattttttgctattatctaagccactaactaagccactaaaaaaaggccgccgttcacacgtcagtgcaaccggcagcccctggttttgttatattattttgtattttattatctttgtctgctataatcttgttatatttctgttttatttcttctcttcatcctgcttttgtatcacagccttcacagcaaccgcctgattggccacatgcgtatgcatttctgtagtcacaagctccatatttcttgcctcaagcgccctgtagatggcatcatgctccttcacaagcatcggataattctttgggtccttcaaatactccactctgtagcggtacatctgctcacggatattgttcatcatagatacaagcttcgcattgtttgttgcctcatagatagcatcgtgaaacttcacatcctcctcagctatctttttcacatctcctgaatccatgctcctcttaaactcgtcctttatggtttttagattcgcaagctgctcatcactgattttcttacaggctattttggctgcaagctcatcaagagcctctctcacctcaagcacatcctccatatccttgagagtcatcttggcaacctctgcgccctttctcggcattgtgactgcaagcccctcctgctcaagcattctgattgcttcacgtataggtgtacggctgactccaagctttgacgcaagctgcagctccataagtctctctcccggcttgagctcaccctttaaaattgcctcacgaagtgtgttaaacaccacatcacgcagtggcagatatgcatccatatttaaagttaaattatcagtcatcaaacttctcctatctcttgtattataattctcacatataagaaaaaagtaactataaagcacccgctgtgctatccggatatcacgttatttgcgattattgtatacagatgtcagatacacctgtctggcaagatgtgagcttctcatggctttgtacgctttctttgcagtatcttcatcgtcaaacagaccaaaaaccgtcggaccactaccgctcatcatggctcctaccgcgccatttgaaagcatatgcttctttatctcgtctatcaccggatagtttggtatggtcacggtctctaagacatttcccatatgtgctgcgatatcatgcagattcttagcctttatatcatctatcaggcggtctatatccggatgaatagtcgtatcatcaagcttcagattctggtacacaaattttgtggataccgagatggacggctttgcaataagcaccggacactttaccattggaggaagaggactaagcgcctctcctatgccctcggccagcgccgtgcctctcataatacagtatggtacatccgcacctatctgcacacctctttccataagctgtctctttgtcagtcccagtgaaaaaagcctgtttacacctataagcatagccgccgcatcagtactgccccccgccatccctgctgcaacaggaatacgcttgtccagcttcactgatacaccgtcagttatagaaaactcatccatcagaagctttgcagccttgtatatgagattgttctcgtttacagggagaaaagacagattggtctgtatctgtatgccaggctcctttgtccttttgatatcaagcctgtcatacagatgaatggtctgcataatcatacggacctcatgatatccgtcctctctgcgcctcacaacatccagccccagattaatcttggctaatgcttttaatgaaatatcgttattactacccatattgtattacctctgttttttgtatacaaggattataacacaccctgccaaaaagagcaaatttaaatattctcatttaattgttcattttcattacttttcagattttccacgtattgcacaaaaacactatgttcacatagtacatgtttactagatttaaaaagtaaccctctaacgcaccacaacaaaaagcctcacagcatatcaataatgcttgtggggctttttttaaaaagtttctctaaactcgtatgtacaatttttctatttcttttccaatataaatttgctaatcagctcgttcattgtctccgcctgtgctgaaagctcctcacttgttgctgatgtttcctctgcatttgctgagttggactgtacaacatctgatatctgattaataccggcctctgcctgctccatagcctttgcctgctcctccgcaatctcgctgagtttttgagaagaatctgcaacttccttcataccattgataaccttttcaatagaagtacttacgcgctctgcagcttcattaccctcgttagataccgcaatggcactctctataagctgacgtgtgtcaaccgcagccttggcactctgctctgaaagacttctgatttgtcccgcaacaactgcgaatcctttacctgcctcacctgcacgcgctgcctcgatagctgcattgagtgaaagaaggtttgtctgactggcaatatcctcaatctcagaaatgatattctcaatctgcttagatgtatcattgatgcgtccgataacatcaaccatgccctgcatctctgtatggctgtgatctgcttcctcagcatactcctgtgcaatcctgtatgtatcattgagcttctcagatgttttctcaacaccgcctgtgatatctgcaaatgtagcctgaagctcctcaatggctgctgactgatccatagtaccttctgctatttcctgtgctgcctgagcaaggttgttagaacctgctgtaacaagtgatgatatctcattgatatgtgacataacatcattcatctgtgtcttcatctgacgcattgccatgagaagtccaataaaatctccggtatatttatcttccatgtctgatgaaactgtataatctccttctgccatctttccaagaagcttgtcagagtcagatatgatagtcttaaggtctgctgccatgtttttcgcaacccctaccatatcagcaatttcatcttgtgaatcaactgccgggaatggagcctcaagatcaccctgtgcaaatgtacgtaatctctgttttaactcatcgagtggtttagaaataccaactgcaacttcgtccccaattttcatcgagataaaatatgaactgacaatgataacaataacaataccaaatacggcatatgatactaatgataatctcttgcttaaattatctccctctgttacctttgtatccataagggcaacaagctgctgatatatatcatcatatgcaggtgcaagatctgctactgctctctcctcggcctccttctgtgtctcaggatctgtagcattcctacctaactgtccgatttcatcatcgagactccagtatgagtcgagcttactgtttatatcatcatatatagcctgctcctcatctgtctttatagagctttgcagctctttccagtatttttgaaatgattcctttttagaatcatgtgtatcagacatcttacttaatgtgtcagaagctgtataaccgataagagctcgtgtagcgcttcgtgtctctgagaaggttaccataacctttcctatatctccctgtgaaaatccgtaaaaggttagtgcgctggaatatctcattgatacaagaatcataagaatacccgcgataacccccgatgccgatgctacaaatgtagtcagtctgaagcctttctttaaacgatttttgatgctaagtgctttccactttgacatgtctaatttcatgatatttcctccacatgaataatgatacttatatactattcttctattatacacctctcaaaaaattatacaagcactaaaaaggtgactgcacgctgcgtgcagcccccttttcataattcataaatcagatttcttatataatattcgttccatcacgacacttttacatacacatccggcttctagccctgtacctgtgtgtcctctgtgccattcttccagtcatcaaacttcttgagcactgcatcatatgtatcctgacatattgatggcagcttgtctccccaggctcctgttgcctgtgaaaagcctttcttgaatgcattcaaaagctcatcagccttgtccttgtcgcctcccgacagtgcctttgcaaagtcaagaatacggtctgaggtcttctcaacgccccagtatccatcttctgcgatgtcctttttggcctgcgctatcgtgtctgcatctacagtcagattctcaaacagactctttaagccctgtgacttgtcccatgttgaagcctgtcctgtcatggactttctgacgatctcgataagctgctgctgtctggcattggcatcatccttaagtgcctgtaccagtgcatctctgtctgccttgctcatcttctggtttactgtgccctttgcagtatcctttgaatcatccttgctgtctgatttctcatatacagctgcctcctcgctgaagcctgcagtctttgcatccgacttatccgtctttgcatcctgcttctttgaagcgatattagtattctttgtctgcgcctcgtcctttgctgtgacactctgcgccgctactgctgaaactacacttgaaatagcatctaacatttctcatccctccctggtaatgtgcgcgcgggaatcctttcccgctatactattatcaccctgtatagcgtctgatatagctaaacagtttatctcttatactgtgtatcggctgttttgcgtctgttgcttatagctttagccgttattttttcagctttctgccaaatataaatgtcgaaaaatatattaccgatgcaataatcactatcatcgggcctgttgccacattggtgtagtatgacactgcgaggccgactataccggaaaatactgaaaatatcactgaaaagaaatgatactcacgcatattttccgaaatattccttgatgaagccgccggtaatataagcagagcatttattataagtatacctatccacttgattgatagcataactatgagtgctacaagcaccgcaaacagattatccagaagacgcacatggatacccttgctttttgccacgcttctgtgtatacatatggcgttgagcttattgaagcaaaacacccagaacactatcgtgaccacaaaaatcacaattaaataaactatctcagtctttgtgatgcttagcacatcgcccaccagtatacttgagtatttgctgaaattgccaccctttgacagtatcgcaagacctatcgccacagagcacgatgaaaataccgatataatggtatctgtcgatgcagtgttcagactgcctatcttatttaaaagaagtgcaaacactatcgcaaatatcaccatggcaagcgaggtgtctgccatgccgcataccactccgacagcgattccggtaagtgctgaatgtccgagtgcatctgaaaagtatgccatctttttgtttacaatcatggttcccattatgccaaaaagcggtgtgatgatgagcacagcgataagggcatttctcatgaaatcatattgaagccaggaggttatattcatttgtgctcctcctctctcacccaggattcctctcctgtgtaaaaaattctctcaaattccttgctctcgaagacttccttcacagttccctgctttgctactgtcttatcaagcagcacaacatggtctgcgtactttgccacatagtccaaatcatgtgatatcagtatgattgcaaggtcatagtgagtctttaaataatccatggtcttatagaaaagctccatgccgttttggtctattccggacaccggctcatccaacagtagcaggttcggctcgtccatgattgccatggaaagaagcactctctgcagctgtcctcccgagaggttgcacacctgcttgtcgatgagctcctcagcctcaaatacctcgagtgtctcccttatctttgcctctatctttttgctctttggcagaaaaacaggataattgtactgatagcttgctatgaggtcatacacgctgaccggtgtatttttctcgatattgacagactgcggcacatagccgattttaagcttagccatatgtccgtccttagtatccttgaactcaatcgtaccggtgtgaggtatctcgcccagtatcgcctttatgagtgtagattttccggcaccgttttggcctattatgacattgaaggagccacagtgtatgtgcatatttacatcctcaagcaccgtctgctctccgaagctcactccaaggttatttatttttatgcaatgaaagccacatggctgtattattttccgcatattttctccaattttatttagtaaatgcctctttgataagctctatattgtgctccataccataaagatagctgtccttgtcgtactctcccctgttgagagggtcgatataaatcacatgcacatctgtctcacgcgatacggtatctcccatgctccttccgtagagctcctcagcgagtattaccgacactccgtcatcctttatggcacctattacctgctttatctcacctgcgctgactgagcgctcctcgtcaaggtctaacagatagcatgcattcatggaaaaatcatcagctacatacgcataggcctcatggaatatgatgatattctgtccattggtaagactctttaggctatttatcttttcttcaagcactgcaagctttgcatcatatgcttttgcatttgcataatattcatcagcatgctttgcatccttttcggcaagccgggatgcgattgtctgaaccatggtgcggtaacgcggcacgctcatccatgcatgggcattctcatcaccatggtcatgatcgtgcgcgctatctgattctgcgtctgcttcgtggtcatggtcgtggtcactgtccgattctgtgtctgcgtcgtggtcatggtcgtggtcactgtccgattctgtgtctgcgtcgtgatcatggtcgtggtcactgtctgcatcatcctcagaaagaagtgccacatcctcacaggcctcaaccacatcaagcttcggatacgcctttgccacatctgacataaacgactctataccgcctccgtttattacaaaaacatcggctgtggataaaagcttcatatcctccggtgtgagctggaaatcatgcagacaaccggtctgtggctcgcttagattttcaagtctaacgccttccactccgtctactatatttaaagctgcaatatacattggatagaaggatgtcacgacagtaagcatatcgtctgcttcgtcagtattttttgtattgcccgaagcatttgatgctccaccggcagcgcctttcatacctgctgtgtgctcatatgccattaccgcaagcgtacacactatcaatatacacaaaaacataatgcctacaaatttgcatttattcttcatatattaaatattcgcctttctttctataactttatttctttttatgattattaacgctttttttgctcttggccttatctctgcgttctttagtctttttggcaaccggctttccggtcttcttccagcgctcctttttgtgcggttttgatgcagcggctctttttgcagctgattttgcctcgcgctttgcttcttcctcctgtttcatggcaagaagcgtctcctcgtcaaacacgagtgaatctatgagattccagatttcgtccctgccttcctttgacatggacgaaaacggtataactaccgtgcccggcttcacatgaagcacatccttgatagtctttatgtgtgcggcaatctggctttttttcaatttatcagatttggttgcaatgataatcggtgcaaagccctggtttaccatccagtcatacatcatgatatcattgtccgatggctcatgccttatatctattaaaagaaacactgcctgaagctttttggaggtgtgaagatagttttctatcatctgtccccatttagcttttatctcgatattggcattggcatagccatagcccggcagatcgaccagatacatggcgtcattgacgttataaaaattgatggtctgtgtcttgccgggctgtgaagagatcctggcaagtgactttctgttcatgagtgcgttgatcagtgacgacttgcctacatttgacttgccggcgaatgccacctcattatactcattgtcagggattgtgcttgtaattccgcaaactgtctctaaattaacacttttaattaccataatctcttcctcattcttattttacaaatgctatcttctccacctgtgaaaatttctccaccggcacgatttccatgccgtctgttatttcttttgaaatctcctccaggtccttttcattatcctttggaatacacactgtttttattccgattactttggctgcaagcagcttttccttgagtcctcctatcggaagcaccctgcctcgcagtgttatctcgcctgtcatggctacatctgccctgacaggtctgtctgtaatggctgagagcatggctgtcgccatagtgatacctgcagatggtccgtcctttggcactgcgccctccgggatatgtatatggatatcatgcttcgtgtaaaactctgcatcaattccatatccttcgcttattgagcgcacatagctaagtgccgcctgtgccgactccttcatcacgtcgcctagcttaccggtgagcacgagctcacccttgcccggtagcacattcacctcaacctcgagtgtgactccgcccacgctggtccatgccaggcctctaacgattccaacctctgcgcgatcatttttcttctccggactgtacttcggattgcccagatatgtcttaagattggtctttgtaacctttacagcagcttcgctgtccttaaagatttccctggcagccttgcggcacagcttgccgatagtcctctcaaggcttctgactccggcctctctggtgtacagcctgataatatcctttagggccgagtctgttatcgtaagctgttcctttttaattccgtttttgctcttttgcttctcaaccaggtgttccttagctatgtgaaatttctcattttcagtgtagcttgacacctcaataagctccatcctgtcaagaagcggctttggaatgcctgaaacctcatttgccgttgcaataaaaagcacctccgacaaatccacaggcatctcaatgtaatgatccctgaatctgcagttctgctcactgtcaagcacctcgagaagagcggctgatgtgtcacccttgtagtcacttgacaccttatctatctcatccaacagcatgagaggatttgaaacgcctgcctgtcttaagccatttactatacggcccggcatagcaccgatatatgtctttctgtgtccacggatttctgcctcatcacgcacaccaccaagagaaatacgcacatatttcttctccagtgcagacgcaattgaacgggctatgcttgtctttcctgttcccggaggacctacaagacaaattataggactctctcccttgcttgtcagatttctgactgccagaaactcaagtattctctccttaacatcctttaatccgtagtgatcatcatcgagcacctgtgctgcatggtcaagatccttgttgtccacagacatcctattccacggaagctcaagtacagtctctatatagcctctctcaacagtgctctctgatgagctgctgctcatatttctaaagcgctttatctcttttttcgtcttttcctttacgtagtcaggcgcatctaactcagatagctttttctcatattcatcagcctccgagtcagcattctcgcccagctcctcacgtatcacaccaagctgttcacgaagcacatactccttctgatgcttgtccacacgaacctttacttttttctgaagctcattctttatggaaataacctccacctgggagagaagtaatgatactataacctgatatctgtcattgatatcctctgcctcaagcacctgctgcttaagctcatatgacaccggcagattgttggttacataatcaatgagcttttcaagatcctcatactgatctatctgtctgataagctccttgctgattttgccgacgactgccgcatatctgtgaaaagcctctctgactccgagaagcatggcttccctgagatcatccggcaggctgtctgcattactatcacaataacagatttctgcctcaaggtacttctcattaccggtaaagccaagcaatgctgcccggcttattccatctacaagtattctcacaacatcattctgtaatctgacaacctgctttatgtcagcaacaatacccatctgatagaggtcttcctgagtcgggtcctcactgtccacattcctttgtgtgacaagataaatcttttgatcctgctccatagcctcctcgacagcacgaagggagcgctctctgctgatgtcgaaatgggcaatcatccccggcagaatagtaagccctctcagcgctactgcaggcatattcataatctgttcttccacttatatctcctgtattattacacagccatgcataacaaaccgctgtgcaatttatattatccgatgctgtatcttttgtaaaataccgccatgtacttatgatgccgctttttcctcgatatatgcctccggcacacactcaccatcaagctttaagttttcctcaactgtatccttgtcgattacgcacttgctgatgctcttgtctgatggtatacgatacataaggtcaagcataacagcctccatgatggcacgaagtcctctggctcctgtctttctctcaagtgccttgtcagcgatggcatttactgcatcgtctgtgaactcaagacctactccgtcaagttcaaaaagcttggtgtactgcttgataagcgagttcttaggctccttaagtatacggataagtgcatccctgtcgagtgcctcgagagaaacggtaataggtacacgtccgataaactcaggaatcaatccaaactttacaaaatcctgtggaagtgcatgcttaaacgcctctcctacattgagctctgtctttgactttacatctgaattgaagcctatagatgatgtatccatacgactgtcgataattttttccagaccatcaaatgctccaccgcagataaaaagtatattagtagtatcaataggtataagctcctgctgtggatgctttctgccgccctgtggcggtacagatgcctctgtgccctcaagaatctttaaaagagcttgctgtacaccctcgcctgacacatctctggtgattgagacattctctgatttctttgtaattttatctatctcatctatataaatgataccatgctctgcacgctcgatatcataatctgccgcctgaataagctttaacaggatattctccacatcctcacctacgtatcctgcctctgtaagtgttgtagcatcagcgatagcaaatggaacatttatcactctggcaagtgtctgcgcaagaagtgtctttcctgaacctgtaggtccaagcatgagaatattactcttctgaagctctacatctgatgtatcacctgccagtactctcttatagtgattgtatacagcaaccgaaagcaccttctttgcctggtcctgtcctattacataatcgtccagaaacgccttaagctcctccggagtaacaagatttatatcatccttagcgctgcttttgtcctcatggccctctacgccttcttcctcaagaatctcggcacatatatctatacactcatcgcagataaaagctccattaggtccggaaatcaaacgatttacctggtcctgtgtcttaccgcaaaatgagcagcgaatctttccgtcgttttttcctgccattattaactccttttattgcatgagggcatcccatatggggtaccctcttaaattcatctaacttctgattatctgtttgttattacactgtctatgagaccatactctgcggcttcctgtgctgacatatagttgtctcgctctgtatcagctgcaattgtctcgtatgacttgcctgtattggctgctaaaatttcgtttaatctcttctttgtctttaaaatattttctgcagcaatctgaatctcagtagcctgaccctttgcaccgccagatggctgatgaatcataatctctgcatttggaagagcatatctcttgccctttgcaccgcctgcaagaaggaaagctcccatgcttgctgcaagaccgatacagattgttgaaacatcacacttgatgtactgcatagtatcgtaaatagcaagtcctgctgtaaccattccacccggtgaattgatgtaaaggtggatatccttattcggatcctcggactcaaggaataaaagctgggcaacaacaaggctggctgttgtctcatttacttcctctccaaggaaaatgatacgatcttttaataatctggagtaaatatcgtagttgcgctctcctctgctggtctgttcaatgacatatggtactaaactcatataaaatacctcctttataaaagctcaaaagaccggctcagaaaataggcttctgagccagtccatcaaattttgattcaaaaaatcttattcttctgtagactcttctgcatcagcctttttctttgcctttgcacgctctttaacgttgtccatgataagatctactgcctttgtgatagcaaggtctttcttcatagactccttctcagcatctcccatgtactctttaagcttatcagcctccatgccgtatgccttagccatcttctctacctcagcatcgatatctgcatcagtaacctcgatattttcctccttggcaatctgctcaagtacaaggctgctctggatacgtgttgtagcctcaggacgaacctgatccttaagctggtcaactgtcatgcctgagaactgtaagtactgctccattgtaagaccgctctgtgcgattctctgagcaaactcctcaaccattgtctcacactgtgtctcaatcattgcctcaggaagatccatctttgacttgtcgataatcttctggatagcctcatcctctttagtcttcttagcttctgtctctttcttctctgtgaggttctttttgatttcctctttgtactcagctaatgtatcaacacctgctgcatcctgtgcaaactcatcatcaagctctggaagctccttagccttgatctcgttgatcttaaccttgaatgtagccggctttcctgcaaggtctgctgcctgatacttctcagggaatgttacattgacctcaacctcatcgcctgtgttctttcctactaactgatcctcgaatgtatcgatgaatgtgtgtgaaccaatctctaatggatgattctcaccctttccaccctcgaaagctactccgtcaacaaatccctcgaagtcgataactgctgtatctccctctgctacaggacgatctgtaactgtaactgttcttgcatttttgtttctctggttctcaagctcagcgtcaacctcttcatcagaaactgatgtgtcgatctttgtaactgtaacgcccatgtacttaccaagagtaacctcaggtcttacagcaacctctgctgtgtagatgaaaggctgtcccttctcaatctgagtaacctcaactgttgggcgtgaaacaatgtcaacaccgctctcgtcaactgcacctgcgtatgtctgctgcataagaatgtttgctgcatcctcgtagaacacacctgctccatacattttctcaatcatagctcttggcacttttcctttacggaatccaggtacactaatctgtttcttctgcttctgatatgcagaatccaatgctttctctaattcctcagctgctacctcaatagtaagcttcgccatattatgctctaaattctcaacctgtacactcatgtcaatcgttatcctccttaaaaatatatatgaatggtatgtacatcaaatgtaatgtgggcatgctttttaaactgctaagcccagtcattggatgattataacacaacaaatccactatttccagtgttttttacattaaatttgcttttgtgtataattccataaattgtcagcaataccaaaacatatttttgtcattttacggcataatatttccatacacatacagcttgtgtataacgttttaaaaggaggtattgcattatggcagcatcaagtagtaaaaaggcttctgtaccggaggcaaaagaggctatgagccgtttcaaggaagaggttgcttcagagcttggagttcctttaaaggagggctacaacggtgaccttacttctaagcaggccggttcaatcggtggcgagatggtcaagcagatgatcatgaagcaggagcagcagatgaaataagctctgcaatagcaggcttcaaatgtacgcttcaaatgcaagcataaaaagaggccgcgcaccatggggtttggtgtgtgacctcttttgttataatactaataatatgattatttgctgaacgttgtattagtataccagtccctgtcgaatatgctctactgtggcatcgtctgtgaagtatctgacaagctcaagtgcaaacgcaatagctgttcccattccacgacttgtaatcacattgccatccacaactacaggctgctcaagccactgtgcaccgagcagcttttcctcaaagcccggatgacaggtagcttttttgccctcaagtatatgattctcaccgagcacgctaggcgctgcacatatcgctgcaacaagctttccctcagcggcaaatctcttaattgtctttactacagtctcatccgcgccaaggtttaatgtacccggcatgcctcccggcagtacgattgcatcgtagctgtcaaaatcagcctgtgcctttgtggtatctgtcttaaatgtcacctgatgagagcttgtcacctctgctttttccgtgattgatatggtttcaatctcaagctttgctcttctaactatatcgactactgtaagtccttcaatctcctcacagccgtctgccataaaaattcctactttaatcatatttttctcctttatttttctttgataatactatgataccttttgaccctttaatcatactataaaaagctgcggttcgtccttgaatttttaaataccggtcattataatcatatataaatgatattatggtaaaacaaaagtataaaccgtaactataaatctaccagtaacctgaaaggatataccatggaaatcgaaagaaaatacttacttaaacagcttccttccaatttagacagctacgcgagcaaaaaaatcgcccagggctatctgtgcacctcgcctgttgtcagagtcagacgctcaaatgacagctattatatgacatacaagggagccggtcttatggtgcgcgaggagtacaatcttcctctcacaaaagaagcctacgaccatcttgtcaaaaagattgacggtcgtctcatcgaaaagacacgctatctcatacctctcgacggcggtctgaccgcagagcttgatgtatttgagggcgatttggctcctcttacacttgtggaggttgaattcgactctgtcgacgcagcaaatgaattcacagcgcctgactggtttggcgaggatgtcactgaatccggcaaatatcacaacagctatctgagccgattggaaaattcatagtactgcctggtctttatcgtattctttaaatcatcataccgcttttgcaatgggccctcaggaactacaacatccataaccaccgctatgtcatctataaggcggtcggttatgatatccctcattgaaataagtatattgtacttctcttcaaaggtatccgcatcaagaaactccagcaaacgcggatccggtgcctggccttcatctgcatccggtgccggctcataacatgcctgtgtctgaacactcacagcttcaggtgcattagctgcaatcgcattagtgctcaaagagatactctttcccgacatatcctccggcttatccttaagtgtgatcttctcaaatctgtatttctgcttcacatcaggatatttctcatggtccacctcgcttacaaacatgtcgagtggtctggcgtatatcccaaaatcatcatataaagcctgataaatcacaagcttttcccctgtctctgaatgtgttgccactgtaactatctgatacagcttattcttaaagtgcctgtaaagctctccgggctttggtgttctgtccatcatttctgcctcttttcctattatttaaaagttgttaatcatgtctaagccttctccaaggaaatctctctcaaactccagattaccgctgtatcccatggcaatcagatcctcaacactgccaaacatgctctgtgtctcagcctctataatctttgcaccgtctgccgctttggtatgcagtgtctggcagtttcttgagtgctcctgagccatcctctgctgtgcctcgctatgtccgtgcatagcctcaagctctttttgtgtcgtatcatccgcaaagcgtgcgttatttttcacagccctctgcactatatccggattgctctgctgtggtctctgctgcggctgtactctctgctgcatctgtggtctctgaggctgctgtgctctctgctgcatctgtggctgtggtttctgctgatatgtctggttcaatgcattcatacccgactgaactgtattctgcatgctgttccatatctgctgtatctgcttctgctgcggtctcggcttgtttggctgcgtatttttgctacctgcgctctttgattttttgttaatgtaaaaaactgctcctaaaataatagcccaaattataatatccatattctgctcctttatcaatctgcattttctatgtcaatccctgaatatcctgcacatatcgcgcagtatgtactccgctgtctgttccggctcccattgctttgcaactcccacaaggagcggcttaagctctgacagtatccttgccgcgcgccggtctgtcgtgccctcatacttatcgtttatggcctcagcctgcttcacacatgcctcaagctgctttaatatatccttccagaactcctcgtaatatatctcatgcactctcttagtcttttgtgtgaaatttagctctgcaagctctttgttgctgtgccccagatagaaatatgacagagcaaacaaatcaggctttttcctttcaagcccctcatttgtcaggtgtatcagattctctatctcactctgtaaaatgataccgttgtcaaaggatgacagatatctctccccctgctttacaacagagtccagagtcgtgtgaaaatccgtgtccaccttgctgattaaaaattcatcgtcaaacatgccgcttttcgctttgcaagcctttatcagctctccaaagtgcttccggtctgttcctgtgagctcacaatacccgataacttgttgctcaagctcctttaaatctgaaagtaggctgcttaaacctgtcttcacgccataatagcgctttgcaacaccggaggaattctttttggttttgacatacagcttaagccagctgttgaccactgtcatgtcggcacctgccgtatccatcgctgtcttaaatttcttttccgtatcacttagtcctaaaatcatcacacaccctcaaacatcattctaaaactatataataacaattctacaccattatcatatttttttaaagagccttttttcgctctgaaaagcccactttaaacgcaaaaaaaggaagccatacaatagctgtatgacttcctgtatactctgcatgttattcgcatcgtcgtgcgaatggcacgagcggctttgttatgatagcaaaatcagattaacgaccgaactgcatatcgttgttacctgattttgttgtgaacatctcaagcatgttgattggatcgttgtaatccataagccatccctcacgggcgaaatcaaactgtccgtccttacggctgttaaggaatacgttccactcctgctgctcaacctttaagttgatacctacctttgaaagatcagcctgaatagcctcaccaatctttacattggcctctgagttgtttacaaggtatgagaactcgacagtctggtttacctggcctgtgctctcatctaataatccgatagaagcaagaagctctttagcctcctcaaagttcttatcgtaatctgtgccgtagtaatctttgttcttgaactcgccaccgttaccatctgtaacgccctctgggataaatgttgtggcaatcttctgtccgccctgggcgattgtatcgataatgtactgacgatcgataagaagacagattgcttttctgaataccttagcctggtcagcatctaatccaagttctgagtagatcttagagttaatgttgaagcctacgtagtatgttccaaggttgtcaactgtgtagaactcgcttgtcttcttagctgcctcaatctcggctgtaggaattgtatcgatgaaatcaaggtcaccgttctggtaagctgtgtaagctgaaacatcatcagatgtaagcattacgttcatctcatcaactgttacattgtcagcatcccagtagttaggattcttaacatatgtcatgcttgaatcatgcttccactccttgagtgtgaatgcaccgtttgtaacgaacttgtcgcttgcatcgtttgcccagtcatcatttccctctactgacttctggtttacagggaagaagaatgggaatgcacataagtcaaggaagtatggtgtaactgctttaagcttgactgtaagagtctttccatcctcagaagctactacatcatcagcagcaagaccctttgtatcatcatatcctgcgaatactgcgcaaaggtagctgtaatctgcagctgtcttaggatctgctgctctcttccaagaccactcgaaatcctttgcagtaagctcatcaccatttgaccacttaagaccgtcacgcattgtgaatgtgtatgtgagaccatcctcagaaacctcatagctctctgcacatgcaggctcaagcttgccctcagcgttgtaacgcataagaccctcaaagctgtttactgcaagacatccgccgtcaacagtactgtttaatgcaggatcgatatgatcaggctctgatgccatgaagatgtttaactttccggcattctttgtgttctttgcattgtagaagtatttcataccctctactgttgagtatacgtctgtgacataatccttgagcatatactggtcattgtagtagtaaagtggaataacacaccatgtatccataagcatatcctctgcctggtgcatcatctctgcacgctttgcaagatctgcttctgtacggatagattctactaactcatcatagcctgtccagtctacgcctgctgatacagcagtatgagaagtgccgttagcagatgtgtcgttagtagatattttgccctcgctcttgcttccacaagcagtcatgccaagtgccatagctgcaacaagagtaagtgctactaatctctttttcatctttcttcctccttatataatgaaaaataaatttatgttagaaccggcacaagcggcttaagctatatgccggtaaaaaccttatattagcggttgaagcatgcaaccatatgtccgtttcctctgtctgtaagctccggacgtgctgctgcacactgttctgtcgcatatttacaacgcgaacggaatggacagccgctaggcatgcgaagaggcgaaggaacatctccctcaagcacgattcgcttgctgtgtctggcagtctcaggatccgggatcggaaccgctgaaagcaacgactgtgtgtacggatggattggattgtccatcagctcatccgcatctgcaagctccatcatatgacctaagtacataacagctattctatcagagatatgctgcactacaagcagatcgtgcgctataaacaggtatgataaccctctctccttctgcagatcctcaaacatgttgactacctgggcctgaattgaaacatcaagtgccgataccggctcatcacatacgataaacttcggatctactgcaagcgctcttgctattccgatacgctgtctctgtccacccgaaaactcatgtgcatagcgtgtggcatggtctgcgtttaatccaactgtctccatgagatccataatcatctcatggcgctctttcttgctactgtaaagcttgtgcacatcgagaggctctccaatgatatcctcaaccgtcatacgagggttgagtgatgaatacggatcctggaataccatctgcatctgcttatggtaaggatgcatatccacatctatcttcttctcactgtcaaacaatacattgccgtcaaactcaatgcgtcccgctgtcggctggtacagacgtaaaagagtacgtcctacggttgtctttccacagcccgactcgccaacaagtccaagcgtctcacccggctttatggcaaatgacacatcatcgactgcctttaactccatctttttaaatccgtcatgaacagggaaatactgcttcaaatggtctaccttgagcaggtactcgttgttatttgtctcattactcatttgattttccctcctccatcatattctttatattcatccagcatgatgcgagatgatcttctccaacccagatttcctccggcttttcggtgagacatatcttcatagcggcatcacagcgagggcagaatgcacagccctttggcatgttgagcatattgattggtgtgcctccgataggaacaagcctggtttttgaattggtctttgtagggattgaacgaagcagtccctttgtgtactcatgcgccgggctgtagaatatggcatctgctgttcctctctcacacacacggccaccgtacataactatgatctcatcacacattgaagcaatgacacccagatcatgtgtaaccatgatgattgccatgccgagcttttcctgcagtgactgcataagctcaagaatctgtgcctggatagtcacatcaagagctgttgtcggctcatctgcgataaggatatccggctcacaggctaatgccatagctatcatgacacgctgtctcataccacccgaaagctcatgagggtactgatttacacgcttctcaggctcatttactcctacaagtgtgagcatctctatagcgcgctcctttgcttccttctttgtacgatctgtgtgaagaagcactgcctcctcaagctggtagcctaccgtaaataccggattaagcgatgtcataggatcctggaaaatgattgaacagcattttcctctgaaatctgccattttctttttgttccatttggtgatatcctcacccttatatttcactgagccgcctgtgatggcaccattctcagcaagaatctgcatgattgaatatgctgtaactgactttcctgagcctgactctcctacgattccaagagtctttcccggctcaagcttaaagctgacaccgtttacagctgatacgtctccgttatcggtcttgaaggtagtgtgcagatcagatacttcaagaacaaacttattatcttccatcttactcactccttactatttcgataatttagggtcaaatgcatctcttaaaccgtcaccgataagattcaatgtaagaacaatgatacaaatcgtaagcgccggaaaaataagacgcaatgggtagctctggagtccgccacgcgctgtatttgccaacgaaccaagtgaaggcataggagccgaaacaccaagtccgataaatgacagataactctcagtaaagatggctgatggtatctgaagcgctgtagtaatgatgattactgacagacagttcggtaaaatgtgttttctgatagtgcgggctgatgatgttccgatacactttgctgcgagaatatactcattctgcttgatggtaagaatctgacctcttataagtcttgccattcctacccagtaaagcaatccaaacactatgaaaagtgcaatcatgttgacaccgagctttgaaagcactgtaccctttattacaggtgttagcacctcatttaatacaactgcgagtaaaatgatgagcagcatatccggcaatgaataaatgatatctactattctcatcataaccatatctaccttgccaccgcagaagcctgatacggaaccgtaaatgataccgattataagcacaagcagtgatgcaaacacaccgactcccagcgatacacgagctccgtaaacaacacggataaaatagtctcttccgagctcatctgtgccaaaaatgtgcgggaacagcttctcacctgcatcaatctgtgcctgctcagcctcactgtactggaaaggtcctaagttctgtgcacccttaacgatatctgcatagccgtaaggcacaatctttggtgccagaagaataaccaaaataagtaaaaccaaaactataatagaacccatagccagtggatttttgcggagtctcttaagaccatccttcaagaaggtagttgactcacccataacctcctgctggcgtttctcttcatctgatgccttggcaaaatccttcatatcgaacttgctaaggtcaatctgtgtggagaaaggtgctctcttcatattatctttcatctttatctctccttaatcaagcttaatacgtggatcaatcactttgtatacaatatctgtaatgaggttcgcgcctaccatgatgacagcaaggaaaagtgttgtggccataatcattgtgtaatcacggtttgtgatacagcttacgaacttggagccgagtcctccgatattgaaaatactctcaataaccattgaacctgtgaggataccaccaatcataggtcccacatatgtgatgaccggaatgagcgcattacgaagcgcatgtacaaatataatcttgtactgatgtacacccttggcctttgccgtacggatgtaatcctgtccgagtgcatcaagcattgaagtctttgtaagtcttgtaatatatgccatcggtgaaagtgacagtgacagcaccggaagtaatatcatgttgcttcctgagctgaaggcctgcaccacaccaagctttatacagaagaaataaagtaataacgtagcgatgacaaatgacggcatcgacgtaatcagtgtgacgaagaatactataactcgatccggccacctgtttcgcatcagcgctgctatcgaaccgagcaccactccgaatactatcgcagttagcgccgctaaaagtccaagcttcgctgaaatcgggaagctctccccaatgatatctgagattggacggtctgtcttaagactaacaccgaaatctccgtgcagcacgcctgccatgtaattcttgtactggactataagtggctgatccagtccgtagcgtgcctcaagctctttcattaccgccggactctttgccttctccgaattgaatggaccacccggaattgcattcatggcaaagaatgtaataagactgataatgaagattgtaaaaatcgcgagaataactctctttacaatgtacttacccatatttttctctccctcttggatttgtatcgataatgcattatttttattttttaaagcattatcactgcaccacgtcaaagtattttgtctaatacgctaaaaagtgcgaatgacgtcattgccattacacactccctaatcttgctgtctgatacaactgtcgttctgacgcgaacaattcttttttattatacacagaaatcatactttgtcaattggatatattttcctatattatttttatttttgcataaaaattagtcatttttttataatactcattaataagggtaatttatttagcttataagcattatttatacatttttattcatttttattttcgcattaaaatattaattttcagcgcatgattgctttgaatcgttaagtaccggcgttattctggcattaaactgatatttggtgtataattacatatcattatatatcaaggagccacctatgcttacatacgacgatgcactcaatctcaactactataaaaaaacaacctttaccggctggatgaacggcatgcgctttctcataaagcgtgaggagcctgtcatcaaggaagccaccgaggatacacccgaggaaaagggtgagccaatatttcatgcatggatatggccggggccgtatatttttgacctgaccgacgacagcaaaaagactgacaatacctttccatttacagatgacggaaaaaaacagtgtgtagactggattaatgaggtcattagtgcacactcaaacgaatatccgaaaaataaaacagatggagaaaacctctaaaaaactcttgacttctcaccaaaaatattgtagtatacgttttgtgcaaaacacaagggcttgtagctcagccggttagagcgcacgcctgataagcgtgaggtcggaagttcgagtcttctcaagcccatccttgtaataagcgtattatgaaagccacggattgctctgtggcttttgttttatgtgtatctacacctgcacaatgcgtccgtgtctgcctattcctttaaaaaatcccgcatttattccatcatactttttggcactgcactcagaaaccatgagctgctgcttatatttgtaatcatcccactcgagaattgctgtgacgtagggctgttcctccattacacgcacagtcgtatttttctttgaaaacacagggtattttccggtgtatcccttttgaagcagctccttttcaagcgctttacgcttttcttttatgcgttcatttatctgatttccgtaatttctctcaggataatcctttgatgcctttatcacaagcttataaatatactgataaagcggtactctttttgcatcggctaaatgtctgctcaaaagtttttccgttttctcacatggatttgccctgtagtgtgcaatgagcttaagataatctgtgtccgaaacctccctgcaaagctcctccataatgtctattccctctacacgcgccggaaaatgatactccatcaaatcgccgggtaccggtgtccatctgcgaaacggcgcaaagtaaataaggctctggataaagcattctgtctcgttgcagtattcctttcccatgtacatatacttatcagcgattgttcctaccatatatacaagcatgcgccactgctcctgtccctttacccagaaatgtcctatttcatgatatttaaagcatgcctcatgcacatgcaaattatcaaaccagagtgtgaccacattgtcctgctggtgcagaatgagtccgtagcctttttcacttcctaaaaccaacgatgccgaaataatttcttcctcgctatgataatcgccctttaacactgcattttccacagtaaaatagcattccaccgcgtcattcatgatatatgggattatatatttgtcatcacttctgcatatatcaaatgaaccgtaatcaaagagctctgcgagcatgtaaaatgcgcgtggcatatcttcttttaagccaggaagtgcttttactaaatccttgtaagcctgcattgtggtatcctttcgtataggaaaaatgataaaaaaataagaatttcagaagtaataaaaacctctgaaacccttgtaaatagtacgggcaacaggacttgaacctgcacggtctcccactagaacctaaatctagcgcgtctgccaattccgccatgcccgcaaacactttgacagtatatcattttgtttcaggtgtgtcaacattatttatcacattacaagtcagcttccaaaagcttctatttatccccataatgaaacctgcaggcaagtatatatacatttttatcatctatcttatagattaatctgtccttgtcatttattctcctgctccaaaagccggctaaatctccacttaatgcctccggctttccgcttcccctcaatctattttaccacttctatgaatccgcctgctcatcgcatgtataggtaagcttcttcttgtaggtctcttcataaaccgctttccaggcctcgtagttcttatcaagaatctcctttgcatttaccgcgctataattttataccaaaagaagtgcagaaatcgccttcctgcactatccatactgtagtcatagtctgcgtctatcttttttgccttgattgaagcagaggaaaactcgtcctccagctcgttttcgtaataatatactcgcatgtatgacattttactattattcggttgttttgcaaactttagtttagcgccaatacacaccaaaaaacaacagtaactttttatattctagaaatatccctcgactccctgcaccagtccgtctgccagattttcaagtgtggcatcgctgtggtcagagcatgcgttgccaagctctacatccactgacggtaccgtgctgtatgaggtctgtgtcaggtctattgccatagagccattaccgtttatctttgctccatgagcgcgcagtccttctatcaggcttgccccaagtgcatcatgctgctgccagtgtgatgcaaccggctccataccctttatgcctcccggcactgatatgtaaaagcagcccttatcatagcttagtccgtcaccatcccagtgcagagcgatatgacagtctgccgcattattgcagatgacagtacgtgccacattgtcaagctgtacatcgcttccgtctcttaccataagcacatcatagcctgccgcaagcagcttgtcctttaatatctgcgccatacggagtgtgacagagctctccggtgtaccgtcattaaaggacataccacctgaaactgctactgcttttgttgcgcctgcgcctgttgtaccacctgtggtctttgccgagccgtccggatgacaaagtgtcttcaccgaagtccctccgcttgtaccgtgtccagcattgacacctactactatgtttttgcggtttgctgtagccttgtacatgaccgcacagcctgaatttatcgctgaatggtctgcatactgccatgaaggatttagtgacactgattctccattctcataggatgctctttctacatactgataagaggaattattatcacctgaattattctgctcctcgtccggctgttcggcagtctgttcttcctgctgcgcttctgtctgctgtgtttcttttgcggcctctgttaccacctctgtcacagcttctgtttccgtaggcatctcaaccttctctgcagcctgtgtctctgttgcaggctctgtcggtgtatcctgtgcttttttgccgcatgatgcaagggtaaatatcatcatgcctgtaagtaatattgctgtaaatcgtttcattttatgtaatctccgtttatataattggattgtgtaccagtatgtatcagcgatacatatagatactttatacatattataataaagttcaggaattttttcatctttttttgttttctaaaaaataaactaaaattgcatatatggtcatacaaaataaaaatatatattcacatacagaatactcactcaatgtaatgaaatgtgaattaacaaccgacaataaaaaaacttgtaaaaataaaatagagccagcaaaatataaaatttttgtatttttctttattactataaataaattaataatcatataaattagtattgcaattaacacatatattattttgctcatatattttatcctatctaataattatttttttctattgtcataaacactaaatacttgagctattaatgcaagaagcataatgataaacagccctatgctatttccatataaaaatatagtaaacgcctgtattgcaacgattacccagttaattattaataaaacaagttcaagattttttttcattttcattttctccttttcttaactttttatataaactatcaaatggtaaaatttatatattacttccttcctaattcaccatttctaatatatcagcattttttgaaggaattcacaaatcacttccaaaagtgatatcaatgcacttatcagaatgttgaaagcaaaactttctaaaaatactctataataaactcaattactttcttaatcataattatcttcatatctcttatagttatttgtggcaaatctggccaaccatgtatcaggcggaagtgtccataaaatcaccaaaatccacactatgatacgattgattctcaaaatctttcaaggtttctcactgttcagttatcaatgttctttgttttgctctcttgcgacagcttgattattttatcaaatcgctgttcgtttgtcaagcacttttttatttttttgaactttgttttaagttctctgtcttgcgacagcttatttattctatcaaaatgtttttcatttgtcaagaacttttttgttttcttttgcatatctgttttaaggcaaaagaaagcgcagggggtgggattcgaacccacgcgcccttgcggacaaacggttttcaagaccgcctcgttatgaccacttcgatacccctgcgtgtcacaattaatacttaattgtttagttatctgcacttgttcagcgcaggatttatattatcatcaatgttacaatatgtcaacactaatttctatttttttttacatttttctgcgtttctttaaaaaaagttctgcaatccccatatcttcaggagttgtgacctttatattttcatacgagccctctatgagctttacttttgtgtcactcccatactctactatcattgcatcatccgtaattgccggcacatttttcccatatgacatgtcactaaacagcttatcataggactgagccagcaaatcatattcaaagcattgcggtgtctgaatctgccacaggcttttcctgtcaggagtatttgctgaatatcccaattcatctgacacctttattgtgtcctttacaggcattcctgctacgcatgctttttctttttcaaccgtatgcatagaacgaactattatttcattatccaccagagggcgtgcgccgtcatggatcagcacatagtccgtgccgtttgctgctttaagcccctcatatacagagttgtagcgctctttgcccccctgcactattgctttcaccttcttaaagccatatttttcaattatcgaatgtctgaaatactcaatataatctgcactgcagactatgactatttcatccaccggactatcctcaaatgcttttatactataataaatcacaggctgccccaaaagctccatatactgctttggcatattacttttcatccggcttcctgtaccggctgacagtatgattgctgtgtatttcttcttatccatattcttttattttcctatctatgataaatctgcacattatgtttgcaccccggtgcaaccggaagcaattacagaatcattcaccaagctttagattcggaaccgcattcagatcaagtccggacctcttacctgctataaaatcatagtatgctgccgcacctatcatagcagcattgtctgtacacagtatcggtgacggacgatagaatttaacacccttgcgcgcgcacattttctccatcgcatgacggataacaccattagaagcaacgcctcccgcaatggcaaatttgtccattttaaactcatctatggcattctcagcgtgtccgacaagcacatctgtaaccgcctgttggaacgatgcggccacgtctgcctggtttatttccagtcccttcatcctgcagccgtttaaataattgagtactgccgatttaagtccgctaaagctgaaatcataaactccacccacaatctttgctctcggaaactctatgctgtgcggatcaccctcatgtgaaaccttttctatcttaggaccgcccggatagccaagtcctattgctctcgctaccttgtcaaatgcctctcctgccgcatcatccctcgtgcgtccgaggatctcatatttaccgtaatctaccactctcaccagatgcgtatgtcctcctgatacgacgagtgccagaaatggcggctctaagtctttattttctatataatttgcgctgatatgtccctctatatggtgcactccgacaagaggaatgtttcttgcgtatgctatagcctttgcttctgccacgcctacaagcagtgctcctacgagccccggaccatatgttacgcctattgcgtctatatcgtcgagtgtcatatgtgcatctgaaagtgcctgctctataacctgattaattttctcaatatgctttctggaagctatctccggtactacccctccatataaagtatgaagagctatctgcgatgaaatcacattacttctcagatcacgtccatttactacaactgccgccgcagtctcgtcgcatgagctttcaattgcaagtattttaatttctttttttgtttctgtattttctgtcattttattacaccaatcttaattatattactctattctgtttccgtatcagaatctgcagcaatcttataaaatgtaagaatcctccaacagccttccttatcctgcctgagtacatattcctgatatgtcttagaatacgagctgccctccttcatgaagtaagatgccttgacatatgcaattttactaccattatcggtgacatattttacatcattgctatcacacactccggtctgagcaagtgtaatgccctggtccttgtagctttgcgcatctgccgtgacagactgtttgtaggtatcctttggattgtttgctgcaagctcgtcatcaaaaagcttaagcgcctggtcggtgagtgcatcaagctcttcatcgctatactgcataccatagtagcacttcacaatcctgttataaagcttcaccacctcacgaggtgtctgcggatagttcttgtcgagatccttagttgttattctttgtacctcggtcagtaccttttccttttgattagcccttttagacttgtcgtttacgacataaaacgaaccacatatcgcagcaatcagcgctattgttaaaataactatacctgttttcttcatatcgcccctccttagtcctcgtcaaacatgagctccacactctttgcatcttttccaagatatgcgtttgcaaaaatatccctcacctgtggcatataatcctctgcacggacaagtgacggggaaaaatgtgtaagccacagctccttcacgccggctctctttgccatgtctgctgcctcgtaaaaggtcatatgcttatactgctttgcttttactatcttttccttttcagcatacatgccctcgcagataaaaaggtctgatccctctgctgcctccactatgtgctcaagtggccttgagtccgtacaatatgtgacctttatgccctttcttgccggtccaagcaccatatccggagtatacactctgccctcaaattcaacggtattgcctttctgaagaggattccacaggcgcatcggaatttctttttcctttgctctttccacggaaaatctgccactacgctttatctcaaccgaatagccatagcacagcaccgcatgctttacgcggaatgcatggatatgatatccattcatctcaaaatattcatcctgctcattgagctctatgcattttatctcaaaaggcagctccggcgcaatcgtccgaagtgcagtgacaacccttgtaagccccttaggtccaataatggtaagcggctcggtgcgctcggcatttcccattgtaagaagaagccccggcaatccgctgatatggtctgcatgaaagtgggtgatgcataaaatatctatcggcttgaaattgattccggcctccttcatcgcaatctgcgttccctcaccgcagtcaataagtatattgctgccgttatattttagtgaaagtgccgtaagccatctgtttggcaaaggcatcatgcctgctgttccaagtaaacacacgtctaacataaattttcctccgcagtataggacatgatgacaccgtcctctaccggatgctcatatagattttttctgattccaaggtttacaaaccccatcttctgatacagtgatatcgcagcctcattagtcaccctggcttcgagcacaatgcgctcaacacctgactcttttgccttttcctgtaagcatctgataagatgtgcacccacaccttttcctcgtgctgattttttgactgctatattggtcagctctccctcatcaaatgacacgtaggtgcactgataccccagtatctcgccatcctcctgtgccacaagcatgatattctccggaagcctcatggcatccaaaaatccctgtctgctccagggctgtgtgaagctgtctttttctatctgcgccaccgagtctgcatcctccggctccatgggtcttattatcatattctaaaatctctctcctttccctgtctctctctctcagcctgtgataatctgagatactcaggcttatggtctgctgcattttctgccctgccctgctcatagagcacctgtccaagacatgctacagccgacgctctttgcttattgcacatggcaggcgcaaagtcatagtccacctttacgtgctcattgatataatccctgaacacatccactccgtctccaaggaaaatcaccctgcggccgagctcattgatttggccaactatctcttctatcatcactacgcactgtggcaaaatggtattcatcctgccatcagtaaaatcatacagccctgtataggtctgctgtcttcttgcatccataagcggacacacaacatctgcactgccccacagattgtatgcaagcgcatctacggtaggtacagaaactatctgcttatccagtgccattgcaagccccttcgccgtcgcagagcctatgcgaagccctgtgaacgatcccggtcctgctgagactgcaataaaatctatagtcttaaggtcaagctctgtcatcttagccacctcatcaagcatcggaagaagtgtctgcgaatgtgtctttttataatttatcgtgtattctcctatcagattatcgtccgatacgacagccacactggccacaagccctgagctgtcaagcgcaagtatcttcattataaaacctcttttattgttatttttctatagtcaaagcctttctccaggtctttttcaatagtaatctcttttctcttctttgggagtatctcctcaatgagatttgcccactctatcatcgtaagcccatctccgtagaaataatcctcatagcctatttcatccatctcctcaatgtcaccaatcctgtatacatcgaaatgataaaacggaagcctcccctcctcgtacacctgcactatggtaaatgtagggctgtttatcggctctgtgatgccaagcccctctgctatgccctgcgtgagcactgttttacccactcctaaatcacccacaagtgtacacacatcccccggctttgcctgctgtccaagcgtaaccccaagtgcatgcgtatcatctgccgaaaagctttctattactgttatatttccttcactactcatattaccagcttatacccttatctatttattttatcttatatctattttgtttatttgattttcagtctgtatttctccagtgtactgcctgccagctcctttaacggctcatagctgtcgcccagctgctcctttgagagaatgtatgcattcttcctgttgctaaatataagtatcctcttatcatttgccacgaatctgtacacctgctcccacggaagctgcgccatctcatctccctggcttacatttatgtgcttttcgtctaccgcaaaatgcagtggctttgagaaaacttcatttgtcttcataatcatctttaccctgcccttgagtgaaaacggcacatatagcagcaccagaatacccactataatataaagcaccacatactccgtattgcctttttgtgcgcttaacactgctgccgcagccaagagcacagcaaacagcaatgatatgacaccctgactgcccttgtacgcctgctctatattaaatgaatataaatctttttctgttacttttacatcaaattcaagcttcatgtcctgctcccaactaaatatttggatttattataacattccttttaaaaaaagaaaagagcgcaattgactgcgctctttatgtttgtgactaatatatattgtgtcaggtattttctctatcctctgccctttaaaaccggtgacagtctcttgtatataagcactgtgataagtgttgatataagtccctttacgatggtaaacggaacattgaatattaaaagtgcctgccacagcttgcctactgatgggagaagtttgctgtatgcatccatgatttcatttattggtgtaaacttctcatatgctggatatacaataaacaggtttgacgggaagctgatgattcccattataactgagccgactatcgcaccaatgatggcaccctttttagtcttgttcttcttgtatataagccctgccgttcctgtaaatactgctccgagaataaagtttgaaagctctcctaccgtaaagctctgtgttactgtacagtgaagcaggttcttgataaactctacaatcactcctgctaacggtccgtatgcaaatgctccgataagtgcaggcaggtctgaaaaatcaaacctaataaaaaacggcatgattggaattggaaactcgaggtactgaagtacaaatgcaagtccgcttaacattcctgtgccgactaaaagtctgatgtttacttttgattttgtgttgtttgttgttacgtccattttacactcctttgatgcttaaggaatcctgaggatattgtgagtgcagctatctaaaatctgaatagctgctttaaaaaatcccggaagaaaatcttccgggacttaatatcacagtgtaatgacacctaataatcttctctcatccagactatactgtcggcttcggaatcacaccgaatcatgccttgcggctcgtgggctgtaccaccggtagggaatcgcaccctgccctgaagaattcctattttttttacaaacttatgatatgcactttgaagtgttttgtcaaggtgtttttaattatcaagaataatattgtcaaagaaattatttttcttgccctttatgtagtgtggctttttgtttctgttgttattattcttgctgcctgtactatttctatcgtttctgctattcctgccgccgttatttctattacttctgtcagccttgttatcgtcattgttttttccactgccgctgtgttctgacttaccggccttgtctgtgccctgtccgattttcatggtaagctggatgcgctgctttttgaggtcaacgctcataacctgcacatctactatgtctcctacactgacagcctcaagcgggtgcttgatatagcggtcacatatctctgagatatgcacaagtccgtcctgatgtactcctatatccacgaagcatccgaaatctattacgtttctgactgtgccctttaataccatacccggtgtgaggtccttcatctcaaggacatcgcttcttagaattggctttggcatatcctcacgcgggtctcttgccggcttttcaagctcttttacgatgtcacgcagtgtgatttcaccaactcctgcctcgtctgcgagcgccttgtaatcagataccttctttgagattccaactacatttctgttctttacatcctccattgtgtagccaagcttttcaagcactgcctttgtggcatcatatgactcaggatgcacgcctgtggcatcaagcgggttctttccgtctgagatacgcatgaagcctgcacactgttcaaatgccttcggtccaagctttgctaccttaagaagctgtgaacgtgatgtgaatttaccgttttcctctctgtagtccacgatgtttttggcaatggtctttgagatgcctgatatgtactcaagcagtgaaactgatgctgtatttaaatctacaccaaccttatttacgcagtcctctacaactcctccgagtgcctctgagagctttttctggttcatatcgtgctgatactgtccgacaccgattgactttggatcaatctttacaagctcagcgagcggatcctgaagtctacgcgccatggatgtggcacttctttgtcccacatcaaaattcggaaactcctccgtggcaagcttgctggctgaatatactgacgcacctgcttcatttactatgatgtactgcacctttaccggaatttcctttaacagctctacaatcacctgctctgactcacgcgatgctgttccgtttccaagtgagataagtgtgacatgatgcttgtctatgagctttttgattacggcctttgcctcctcgaccttgttctgtggtgccgtcgggtagattactgtggtatcgagcacctttcctgtagggtctacgacagaaatcttgcagcctgtacggaatgccggatcccatccaagcacaacctgtcctgcaattggaggctgcatgagaagctgctccaagttctttccgaatacctttatggcaccatcctctgcttcctctgtcagattgtttctgatttcacgctctatggcaggggcaataagcctgtcgtacgcatcctccactacctctgtgagtacggctgctgtaggcgctccatcatttgtgataacctgctttttaagatattttatgatatcctctgtcggtgcctctatctttactgtgaggattttttccttctcaccacggttaattgcgagtgttctgtgacctgccaccttggaaagagcctcatcaaattcatagtacatctcatagacagactccgcctttggatccttggctgtcgatataagacgccccttttgcatggtaagctctctgatttttgttctgtaaccggcattgtctgatacgttctctgcaatgatatcctttgctccggcaagtgcagccgcttcatctgccacgtctttttctgcatccacatatttagctgcttctgccatgatatcaacagacgattcctgcgctaaaatggtctgtgccagtggctctaagcccttttcctttgcgattgtggcacgggttcttctcttcggacggtaaggtctgtacaaatcgtcaaccgccacctgtgtctgtgcctcaaggattgccttcttaagctcatccgtaagcttgccctgctcctcaatgcttgcaagcactgtctgcttcttgtcctcaagattacgtagatatgtcagtctgtcgaagagatttctgagcacctcatcatttaatgagccggttgcctcctttcggtatctggcgataaaaggaatggtgtttccctcatctatcagcttgacagcggcctcggcctgtccttttttaatctgcagttcttctgcaattgcagcaataatatccatttttttacctctttaaaaaacttattcttttcgtattataaatgaagtgatacaataaaatcaactttatagaaaggaattttattatggatccacaaaaatttgattataatcaggattataactataatttcggcaacaattatgggccgggctttaatcccaacaacaatttctacaataaacgctcacgcaatatggaggttgcagcacttgtgctttcaataattgccatcgcgtcgtgcagctgtatttatgtgtctatcatatgcggctcgcttgccatgatttttgcgttactgtcaaaaggcggtgccacttcaatgagcagcatggctatgacctcattctggattgcgtttgccgctgttgttatcactcttattatctatatcggttcgtttgccgccatgcttcacgaatacggaagcatagaaggtatattaaaggaataccagaacctgaccggtatcgactacaatgagctacttcagcagatgaataccgcaaaataatataagcatatttttgactatacagtttaccacaataatggcaagtgcaagccacatatataatggcctgaagtgcattccgatgtgcagcctgccgcggcttatccgctgcagtgtctgtgacagcataaaccagcctccaaaaacggctgtatacggcacaaacggatggagtacaaacgaccttatcagatgtccgtgcagcagcgcaaatgtggctctcgtgccaccgcaccccggacaatagtagcctgtatatgcgtgcagcggacatggaggcacctttgtgagtatctgcgtaccgcatactccaatcactgccgcaagagccgcaaatacagctatgcatatccagcccgttatatagaaatatctgtcgattgtttcatctgtctgcatgatatgtgtggtccttcctgtgattttgtgtaaccatatgaatacaagtatatgctatatatctgacaattgtcaaagcattaatttaaacattaacttaagcattaattcaaaactattatttcaggagaaatataatgaacccaaaaaagaaatccaaagaattaaaaagaatatcaagagaaaacctgaacggaagatacagacttagcatgagcgtttttctcactgtcacactcataaatctgtttagtgacctgccgtttacctatctgctcggaaatgtatatgccacaaaagttcagaccgtcatctactacattgccgaggtgcttttatctatcgtggtcggcgtgctgcagatgggactcatacgtttccaccttaatatggcaagaaagaaagagtgccgtatcagcgatgtattctactgctttatgaatcactccaacagatattttggagcatacatcatatattatgccatctctatgattgcaaaggcgcctttccttgtagccagaaactttttcaagctaagcggcgacactatgggaattgctatcgctttatatgctgcaagtgctgtgctcagctttattgtactggttctgtttccgttttacctgtatctggtgctctctcgcgatgatttatccgtgtttgcatgcctgactcatgcaataaagctgattcgcggcaacatactcagagtcatttacattaacgtaagcttcatcggtatgcttgtgctttgcgtgctgtcgctcggcatcggcctgctctgggtggagccttactatgagcagacctttacaaatctcttcctcgatgtgaccggggagctgccggctgtggactgcgcggtgtaacggcttatataatcgcttgtgcatggagcgcttcgaattcaggttatgtaagtgcatgaagcgcccggtgcacagattatatatcactccgctctcataactccttagtctagtgggagtaaatgccgtcatccgcagagcttatcaggcgcggaaaatcaaacgcgcattttacctcaatatctaaattcaggctatgctgcttgaacgagtattttccgcgccgcttttgctgatgacggcatataactcccacacgacacgtcgtaaatcgaacgtagcgacatacaatctgtgcaccgagcgttccatgcactaatatacttcttctatttatcttactgctccatgcacttactcaacttttatcgaaatttccgaacatgtgggatatataatccacatcccacccgctccacgcacgcactctcaacctaaaatcgaagctctacatctgcagcaaccggtccataatccttgctgcaacgcagctcttgtccatgatttcaagctctgtgcagtcgtcagccgtgatgagtgtgaccacattggtatctgttccaaagcctgcgcctgctacctttaggttatttgccactatcatatctgcatttttctttgcaagctttgctttcgagttttcaagcatattctgggtttccatagaaaaaccgcatatgagctgtcccttggccttgtgtgctccgaggtatgaaaggatgtcctctgtgcgctcaagctcaattacagactcatatgagccgtcatttttctttattttctcatcagccggatgtgatgggcaaaaatccgctactgctgcggtcatgatgataatatcctgttcagcagcctttgatttcaccacgtctgccatgtctgcggccgatgtcacatttaccacatctacaaacataggtggcttaaccgatactgaagcgttgaccagtgtaacatgcgcaccgcggagcatacagttttctgctatggcacgccccatcttgcctgttgagtgattggtgataaaacgtaccgggtctattttttcctgcgtcgctccggctgtgatgagtacgtttttgcccgccaggtccttttcacaggctattgtcctaattatgtagttgaaaagtgtctgtggctccggcatttttcctgcaccggtgtctccgcatgcaagatatccttcagccggctttataatctcaaagccgtagtgttcaagctttttgatattgtcctgcacaatcctgttctcgtacatattggtgttcatggcaggagaaaccagcttaggacatttggctgcaagtattgtggtggtaagcatatcgtctgcgattccgtttgccatcttgcctatcacattggctgatgcaggtgccaccataaagatgtctgctctctttgcgagcgccacatgctctacattgaattcaaagtttctgtcaaatgtgtccacgaggcacttgttgcctgtgagagtttcaaatgtgattggatttataaaatttgttgcattgtgtgtcattatgacgttgacatcggcgtgctgttttacaagcatactcgcaaggtttgctatcttatatgccgctatacttcctgtcactcccaaaactactgtttttccttttaacatgattttcacctctgtataaaactattattattctgcagtcattttttgtttacatcgcaaaatgctttgtagccatccacagactttgcacttctagctgcattggcaatggcctttgccatgacataggcactcattggccccaccagattgatatctgcaggcacactgcccactgatacagcatagattgaatctccgtctgccatcgtgtgcactggtctgattgctctgccatagccattgtgagccatggatgccaccttgcctagtgcggtcttgtcaagctttgcatttgttattattgtaccaattgtggtgtttcctgtaaacatattctgaatcttcgccgctgcctcaaaatacgctgtctcgtcatcaaaaagcagcccattttcatccagtgctccggcaattttcttatctgtatctatatcatatatgtcaccaagtgcgttcagtgtcaccactgctccaacctttagttctccaagctgtactgcataggctcctattccgctcttcatgctgcgctcacgccccatatatttgccgactgttgcgcccattccggctccataatttccctgtaaaaaggtatcataggaagcgttctcacaagccttgtatgccattttgccatcaggccttgcatttttatcacctattaccaggtcaaaaatacacgactgcaccacaagaggcacctttgtaactcccacatcaaagcctatatcgcgctcctcgagatacttcatcacgcctccagctgcatccagaccaaaggcagagccgcctgacagtacaagagcatgtataccctttgcgtctgccacaggatttaaaagtggtgtctcccgcgaagccggtccgcctccccttatgtcaactcccgccggtgactgtttatcaaaaagaaataccgtacagccggtcaagccattagtgtcctcggcttggcctattttgaagccaccgatatccattatgtctatttcatgcatatgtttcaccttgtatcatgcctttcttttaactcaaatgcttttttaccgttcctagtccaactgcttataaaacaggcggaccttatcagtccgccgtacatacaatttcacatttattttaaatctatctgaatttattttgctgcaattggtttgatagtatttaaaaccaatccaacaaggtatacgatgattgcggcaactattgcctcaattactccgttaaagctgatgactccggtgataacgcccagcacagcatttcctgccacaccgattgcatctgcataagcatccttgtaaagcacgaagattgagcccattacaagcagtgtattggtcatggcaccggctacacctgcatatacaaacggaataacctgtgtgctctttctgataaatacagcctcaactactataaatactacagctccgactgctatgccgattcctaaagcggctgcctgtgaaagtgactctgacatcttaccgaggaatgcatatactccgaatgcaaggaatgctgacatgagcacatttaaaactgtgccccagagatttttcttctctgacgcaagcacctttttgatgcctatatatacaaaataaggtataacacctactaaaattcttggaacaaatgctatgaataagctcttaaatatacctgaggttccgaccagggatgcggcaagcaccggcgaaaatacaaaggatgaaagagttcctccgactatagttgcctttagacaactggtaaatccgaatacaaatccaaggaatgctccttttttaggtccgcagaaaagtgaaccaaggattaccggaatgtgaataatcgtagcgttgataactacgagcggaatatatccgagtggtgtgaatgccatgataatgataatggctgtaaataaacctgtcagtacaagttcgtttgtttttgaattgcgcattgtttttcctccttttggtaaaagcccatatgggtctcgtcctaattctgttatgctgtgattctgtcacacggcataaaagcgcacatgaaaattgtatggctgctggattctcgtatgagtaacccgcatttatgtatcataccaccggatgcgtgatgtgtaaatacaaatttgttatatttttaacaaaatgtgttgtcgcagtgcaaatcactgacatatacatcgatgtcttacatatgctgcattgtatctcacaagcgtgaaaaaaaatccccggacatcgtataaatgtccggggaaattatttattctacggtaactgattttgcaaggttacgtggctggtcagggtttaagccctttcctgttgatgtgtagtaagcgataagctgacagattataactgactcgaaaatcacaaactcatccggtgcctgtgggagtgagatatgcacatcacagattgacttatctgtaatatccttgtccttgctaagaaggataacgtatgcgcctctcgcctttacctcgcggatatttgagatgaccttgctgtatacatggctctgtgtagcaactgcgataaccggaacaccctcgctgatgagcgcgattgtaccgtgctttaactctcctgctgcataagcctcagcatgaatataagaaatctctttgagtttgagtgcgccctccatgcttaatgcataatcaagtcctcggcctatgtaaaacgcatttgtagcatttgtcattctcttcgtaagctgttcaatctcaggtgcctgtgtgataactgactcaatgagatttggaacctcctgcagattctcaataaatgtctttgcctcttccttggtcatacggccggatacaagaccaagcttgcatccaatcaggtaaaagcttgccacctgaactgtgtatgccttggtacttgccacggcaatctcaggacctgcgtgtgtataaagtacatagttactctcacgggctattgttgaaccctttacatttacgatagaaagcgtctttttagtatatttattagccagacgaagtgcctctaaggtatcgattgtctcacctgactgtgacacaaaaataaccattgacctgtctgtgagaacaggctgctcatatctgaactctgatgcaatctcaacagaaacaggaataccaaacttgttctttaaaagagcttttccgaccattccagcatacatggctgtaccgcatgctacaactgttatgtcgcttatatcctcgaagaacgaatccgggatattatcatcctcaaaacaaggaagtgaatcctttattcttggagtgatagtccttgtgatagctgttggctgctcatgaatttccttgatcatgaaatgcggatatccatccttctgagctgccgtcacatcccagtttacctcaagataatcaggctcaacttttttaccctctaaatcctccatttcgattccatcagcagtcattatcatgatagtgtactctggaagtataaaatagcgtttcgaatatttgataaacgctgtaagatctgatgcaataaatgctccgtcatcgcaatatgttgcaaccatcgggcttacatttctgacagcaaaaatctttcccggctgatccttaaacatgatacagaacgcaaatgaaccctgaagctctgctactaccttcttaatagtagcctttggatctccgtcatagagcttgttgataagagccgctgctacctctgtatctgtctcagatataagagagtctgcaagatcaaacttgtttacgatctcatggtaattctcaatgataccattgtggatgagtgcgacatttccaaccttgtgaggatgagcattggcattggtaactccgccgtgtgttgcccatcttgtatgtccgattccacaggttgaattgttctcatcatcgcagatagctagaagatccttaacctttccgacggttttgcgaatagaaatcttgcctgtatccttgaaataagcaatacctgcactgtcgtatccacgatactctaacgctgcgagtccttccgtcaaaatcttctgtgcctctaaacggcctgtaaatcctataattccacacatagtgttagatctccttttcgatatataattttaaatgtacaaatacgtaactgttctgtactgaatagctacttgatttttatggttctctcgctttgttttgatgtctccatcatatttggctcgagatgcgcatccatatatgcgtccaggcatccgccgaattttcgataacctgaaacctcgttaaccggcatcattttacgtacctgccggtgcatggcgctaaagtttttaacttttcgaaatccaattgctcctttttcttggactttgttattctaccacattgggataaatgactcaattgtaaaattagccgaatttttcatatatgtgggggtaaatttataatatgcgactgtatatcgtattataacaaaaccctcaggcaaattatcttaaattagttgcctgagggtatgtccttcaattacatctgcactgctgcaggagatttttcaagagtctgttcaacatacctatttaaagtaatatcatgttccgttgcatatataacaattttcttatggagctccggtgatattctaacattgaagcttcctttatatgcctgctccggaacctttccttgttgctcacatattagcaaatactcatcaacagcttcatgaaagccttctacaagctctctggcattttcaccttcatatgatattaatgaacgtattcccataacttttccatagaagattacatcctcctctgaaaactcaacacttccaacatagcctttatattccatagtattattcatataagatcctcctgctcaagatattctattagctgtttgatctgataagctttaagctctttttgtggatgtggtttatggagcataatgcatccatgattttcactttcaaatataactctggatccactggtctttcccttatttgaatagtcaaagtcaaaatatttcaataaagtttctgcttcatcaaacgtaaaatcttttggtcgtgattttaatctcttaatcagtttatcctttttccccataacatgtatctccttttttattattatacatcactttccatttattgcaactatttttagttacaattgtcaatttagttctgattccttcatttgacataaacttacaccatgtcctctaatcttatccccaatattctgaattaataagacaggtgtgagtacgtcggatttatttataaacaatataaagcttagtatatcggattttgcgaaatataacaattgaaaaatccccgacatttacgccggggataagaatatctgatgcaagcaagaacataagtatattttattgtaaattgatattatggcaatttcttccattcaattggtttcaattcgtttatatatgcttcataatctgattcgcttatatcatttctttctacatttattccacctttagaatatcgtatatctccagtattataattggtaaaagcgctcacatcaaatgcaatatcaaaaacatcattatttatcgtgtaatacaaataatcttcattacctactccataatgtgaatcagtaaatgctaatgcatgatattgtggtgaatactccatattcttacaaaaccatataacattcgttttgcgtgatgtatctcctgtgtcataaagatttgcttgaattggtacaatctcctgtgtatcacctttatatgtaaaaacaataatatttccccattcgttttcatttccatatataatcaattcatcaactccattaccatcaatatctaatacagcatattgagatggcataccatattcccaatccgaagttaaatagttattatattcgccattctttatgaatttttcatatataccggcatctatatcttctttgctctttttcggtgtataatttgaaaagaaactaattgtataccccttaatattgttactatattcatcccacttgttcataccttcttcctcagtaatatttttcatcttgctaatgtcatatccatttgaattgctatattcatctccttcaccataaaaccatggtgtgtccttagcatcgtcctcatcatacagaactccttctaccgttgtaagctttaggttatccatatctatcttacattcttccacttctgtaagccccgccccgccagagccatatctgtatattcttccgtttttagataacttgatcccatatctttcacctgatgtatcaaggtaaactatactatcatctatatatgtatataaatcaatgattactccatctgatacagattcattatcccctataagtaattccggaactccgttcccgtcaatatctatcaatgcatatcctacattattcaaagatttcaaattcgtatatggattgctaaacaatggactaacctcatcattatcagtccaattctgatttttaatcttatagtaatacatatctagaacatctttatataattcttctccatccacagaagaaaccacacgctttaacaactcgccatcatcatattcactaagatactgcttattattttccggtaagaaaccatagcaaccatacttattagtcttatccgcatcctttagcttaacaagacactttgcaatttcctgattgaccattttctgtgtgctctcataagtcggattatcttcttttgtcttttcagttaacgctccaaccgctgcatctcttgtgatataacagctctttaaataggcatagcaatactgtgtcacctcgtacagattcttcgatgttatattatttgcatccttgaacacagcatcccttttatcaatataagacttaaaagtatcagactgtacaattccggcatacatactctgcaaaaaacagtccgtattgcttaatccatttttcacccaaggaacagtttccttagaaatgtcccatattaacaaatatatctttgattctgtatcaagtaatgtcgtagaaacatccagcccttctttaagtaaatcacccatattattcatcagataattatatgccgaatatgagactatatctgtttccaacgtatttttataatctctcaaaccatctttcatagccttagacataacacagccgtaatttgaattcttaataaatgtatccaacgattttactgcaaacttgtcctgattttgaaactcacttgcataccctgcaatttctactatagaatagaaatcatccaaaacattagtcagatgattaaaagtatctgtttttgaacataattcgtccagctcttgatatgatttgttaaatgcaatcatagatgctttattttcagcaactacctttttcttcaaatcagcagttgctctagacaaatctcctatcttatcatcatacaaatcatcaatgtctttcattgaatctgaaatccactcacctccatcaaaaggcttcagcttttccttcattgcatctacatcctgactcaattcttcatctgaataagtacagaacatctttgcaaatgattccgaatactttgcatcatagctagacgaatccatgctaaatgaattaatcaactggcaccatgatgctccatcccagtcaagcacaccattaaatatctgaaccatattggctgcagtccccattgcaaacattgaaccaggtgttgctccagcatcagtctcccaatcaaacaaataacggtcattatttttcaacacatccatgtagatatcaactatattcttctccgacatatcaacatgaatctttttatccagtacaacatctgaactatttaacaataacaggctgaattcaaaaggaatccactctccatcagcattctttactgtctcaaatggagcttcataatctagcatcttgttgaataacatatgtccaacctttgtactgtcatagtaaaatgttgtaataccatatggtactgtattactaaattctttgttaaaaatagccacatactcatcgcctgctttaacctgatatccaagcctttctccaagctgttttgcatttacatacaaatgtccatcatctaccatcgcatccagattttctgttgttcctagattatcggagaactcaaccggaagtgtattgtacgaaatatcagcactctttgtttctgtcgcatacgctgtgccggttgtcaataatattattgcgcttaataaaatactaattatttttttcatcaccagtctcctcactaagttccttttgtacatcctgcatcagctcctgataagcagtaaccaaattgccggtcaatgcattgacaaattcctcagtatcgtattctgctgaataaattccatccttatatgtatatggaatttccacttcattagtcactttttcagcatttgaaatataatcatctgtaaatgattctatattttcctctgtcacttcactatttttcatctcggtaaaatacttggaaaaatcaggtgctgttattttatatgtaactgtatcttttcccacctttttcaccttgattgtatcatgctttataattttagacatcaaaccatttttctgctttgcttcggtgtctgtctcaaagaaatcttttaattcctcatctgcttttatttcatcggttccgttaatgatagcatctaattttgttatatctttggattccaccgcgtcaaccaccttgtttgcctgcttttctactttcttgtcggtattaacgtcacaggctgtaaaaatgattgaacatcctagaatcgcgattgctattcctgattttataaatttgcattttttcatgttgctgctccttcctaagagaaatgatttactatgtattttaataaacaaaacttgcgcagatgcaatgcatttaataagattattcgcattagtttattctgcatgattgtatccacaataactatccgcagaatgtaaagataatgattttacacttccattttccagataaatgtcaaaatagtaagtatttgttttatctttacaaaatatagtatctgtttgatctttttgtattgtccagatatcgcttttactcaatatagttcttacgctatccacatccatattatatttaatcccatataacatataaccgccatcgccagttatatcaatctctctaatgctatcgtccttatgacaagcaaaacaaacattatcattttgtttaaattttcctgcatctacttcattttcaattgtgaattttatgttttgatctatttgagatatgttctctccaatatatccggaaagttctattttatcttttccaacattttcttcttcaacctcactataaacactttgagagccttttcttatccaataaagattatatgaattatcatttatatctttcattaccaaatattttttatcttttccaataagcattgtatcttgaacagtctgattttcttcatacatattaatgttatagtttaaatgatcatcttcaatgctacataccccctttccaccaagtcctattccaatatagaacgaaaaatcgccgttttcatcaatttctaaatcagcaccatactgtgttaatccacttccatacataaaactaagagatcgatcattattcttatttgttgcaacactatccaatacccatattcccacaaaatctttcaaatcacttttattttgcacagcatctataattgaactatcatcatactcacccaaatactgttcattattttctggcaagaatccataacacccatacttatttgttttatcagcattttttagcttaatcaaatattccgcaatttcctgatttaccatcttctgtgtgctttcatatgtagggttatttttctttgttttttcagttaatgaacctactgctgcatctcttgttatataacagcttttaagatatgcataacaatactgggagagttcatacagattttccggtgttatattcttagcatctccaaacacaacatttcgtttgtttatatatgtgctaaaggtgtcagactgtataattcccgcatacatactctgtaaaaaacagtcagtattgcttagactatttttgacaagcggaatcgcccctttagcaatatcccacgctaacaagtatagcttagaatccatatccagtattgtagttgatatatctatagtatctgtaaataaatctgtcatattattcatcagataattatacgcagaatatgctacaatatcggtttccagtgtctttttgtaatctcccatgctatctttcatagccttagacataacacagctcgaatcagaattttttattaatatatctaatgattttaccgcaaattcgtcctgatttttaaactcgctggcataaccaataacttccgatatcttataaaatacatccaaaaagctggtaacattcttaaattcttttgaagcggttaaaaatggatctgtcatatctgaaaaataatctgctgtattacacattttatcaagttcttgatatgatttgttaaacttcgctacagatgtgccattttctacatcaatttttttctttaaatcagctgttttttcagataaatctccaatattatcatctataatatcgtcaactttttttattgattttgcaacccaattatccccattaaaaggtttcattttctctttcattgcttttgcattaagagttaattcttcatctgagtatgtacaaaacattctagcaaagctctctgcatattttcgatcatagctatccattttcaggtaaaaactatctattaattgagaccacgacgctccatctttatccaaaataccactaaatacctgaacaaaatatgctcctgtccccatggcaaatattgaaccttctgaagcaccggcatcgcttttccaatcaaataaatatctatcattattttttaatatatccatataaatatctacgatatttttttgtggcatttcaatgtgcacctgattatcaagcacaacatcagaactatttaataataaaagactaaattcaaatggaatccacacaccatcagaattcttaacgatcttaaatggagcttcataatcaaccattttattaaataacatatgtcttacttttgtactatcatagtaaaaggtagtaagaccataaggaactgtattactaaaatttttattgtaaattgctacgtattcatttccaacttcagcctgataaccaagtctatctcctaactgttctgcatctacataaagatgatcatctgtcatcattacattaagttcttctgtcatcccaagattatctgagaactcaacagaaagcgtattataagatatatcagttgtttctgtagctaatgccgtatatgtagatgacattagcataattgcgcaaagaaaaaaactaatcactctcttcattattgatatctcctcacttatctcattttgcacatccaaaatcagtttctgatacgcttcatgttagtgatttataaattctcttatgtcatattctatagaaaatttctcatcctcatatattcatctgctgtatagtcatccataaaagaatctattttttctaccactttatttaataaaaaagtgattcacggaatattacacttatcatgaatcacttttttactatttatctatatcatatatctgattatttttctgctgcaaatctataaacttcatatttatcaccgttttgtctagctatatataatgcatcagatccagctataacagtatcatcaaatatacagctccctttaagtgaaggttcaaaatcgttcccccatgtaaataaatcattagtatcaataatattagcatctgcatctaataatacaactttagaatcactattttttagaaagaaatatctacatactgaaccttcagaacttattggatccaatgcaaaatatctatcattacatatttctatatcatcaccttctaacaaccatgtgtcatcataacttttaattttaatattatcatcttttccaattgtatatcctggtctattttcactctgtcctttgtgaattccagtataatctgtataatatccggtcacttcagagatactaccatcggatgccaaacaatatattttttcatctcctggtgtattaacacttatcaatacattattgtctataatattaactcttaaagaatgactaattgcataaccatcccaaatcgttatattatccttattattcagataaacatgataatcgttaattccttcatatgaatcaattaaataataatcttttgttaattgataatactctataattgggtagcctgtcgaaaatgttccaaccttgcttttatttttatcataaaaattaatttctccgttacctgatgcatattctacatctccattagtatattctttatcaacatatttcatatttaatggtctagaataatattttatactactatcaattttccccagaagaggtttaatttccatttctgaatcgaattccttaccttcagtatctaataaataatcttcatcctgatagcttgcttgaaacaataaagtatctgctccctgttgctcaacctcttgtctattataaaaactcacctcatcatattttaatggaataacttccttacctttagaatttattacaccaaacaatctcccatccattttggatacaataaaatatccattacaataatcttcaactttataatcagttgtaagatataaattgtcttcggtatttttctctactactttctcggtattttcctttgtattttcttcatatgtactctctgaatgattttttacaattttagatatttccgtatttaacgttttctgctcattctgtgtgcttctatttgtagagcatgctcctagtaatgttgatatcaacgctacacccataagtatttttacagttttcttcttcattattttaccagccttcctacacaaatagcatttgttaatcatcatgcatttccttgtaagtttcttcgcatacaaaaacttccttatgcatcatattctcataatgtcgtgtggcttttttaccacaccatgcacatttttttctacaatccttgcaaacataagagtaagaaccatcactttctttatatgccacagtcggactatgtccacaccagtcacacggtttatccgatacagacatcaattgcataaatccccatattacaattactccaacaataagactagggattataactttccatactctagcgctattgttctttggtgctataacatcataaacatgttctgattgttctttctcaacaaccgcaccacatttaccgcaaaaattagctcctttttctattttttcaccacaattaccgcaatagcccatttttaattttctccaattctgttatagtcatattattactcatttacagccttaccatatgaatttgccaaaatatctttttgcgagtcttcggaagcttcaacatcaaaactttctcccgataaaagttccacagctaaaactcgttgatttagtacatcattttcatttagcgtgtcatatgaatgtccacttactgttccagaattctcatctatttcatatactgaataagagcctccaccatttccaccgccataatcatgaaaggccgcaaatatcaatttcgaatcctcataaaaaaactttatcttactcgccggaatagcatctggctcatacgtatatccccaatcacctaattcagcatacacattatctataatttctttttgattctcatctaaatcattataggtataatttttatcactcccatttgattcattatttgtaaacgaacatccgactgtaaaaaacatagtacttagagttaaaattatagttattatcttcttattcatcttacccctctcaaagatattatttcttattattttttcttattaatcttccatagactgagccaataataaataaaacagctgccaaaataatcaacactacaaatgcatccgtactaactgtatagtaagctacaaatgcaaatatagcacatattattcctaaaactgtaaaacctatatccgcgagtaaagaagttttcataatttcattttgatttcccaactctgtcttacagccacaatttggacacacttgtgccgaatcacttatttcttttccacattctggacatcttattaaagccatattaatacctacctttctttataatcctgtgacatctttcctacataaattatagtacaaatatttactaaattcaatagtaaacatctttattatgttaagttatatgtacatgtacggagggggaatatggattacattcaacgaatgcgcaatctacgggaagataacgataaaacccaacagcaaatagccgattatctgggtacatcccagacaatgtatgccagatatgagcgcggagcaaatgaactaccgattcaccatttgcttgctttatgtaaatactataatgtgtccgctgactatatattaggtctttctaatatcaaacaaacttccaaataaaacatctgagtcaaatcctttgcgatttacacacggatgtttttttattaagaaaattacttatttccccaaaaaactctttatatttataagattacgctatatttatggtcaaaaaaacacagcactgcgataaacagtactgtgtttaaatgtattagtaatgtaattttattgcattattatgcgattatgcgtcagcatttgcctctttaagagctgctgtaagctgaggaacgatcttctttaaatctcctactaagccgtaatcagctacgtcgaagattggagcatcctcgtccttgttgatggcgatgatgagatcagactcctccatacctgctacgtgctggattgctcctgagataccgattgcgaagtaaatctgtggacgtacagtctttcctgtctgtcctacctgataatcctgtgctaaccagccgttctctactgctgcacgagagcatgataccataccacccttgaagcatgaagcaaggtcacgaagcatctcgaagttctcagcgcttccaactccacgtccgcctgatacaagtaccttagcgtccatgatgttctctacgttgccaactgccttaacgatatccatgatctcaacataacgattgttctcctcgagtgcaggattgaactcgataacctctgctgctctgccagcctctttaggaagcttctgcataacaccaggacgaactgttgccatctgtggacggttgtcaggacaagcgattgttgcgattgtgtttccaccgaatgcaggacgtgtcatgagaagctggttgtgcttctgctcctgtccaggcatagcgttgattgggaaatcaccaatctcaagctttgtacagtcagctgtaagacctgtcttaactcttgctgaaactgttggtccgaggtcacgtccgatagctgttgcaccaactaacatgatctccggcttgtactcgttgattactgatacaagagcctgtgcgtatggctctgttctgtatgtctcaagtgcaggattgtctacaacgattaccttgtctgcgccgtactcaccgagctctgttgcaagagcctttacgttagatccaagaagtactgcagtaacctctgtatttaaatctgctgctaactctttagctttaccgactaactcaaaggcgatgtcgctaagcttattgtctacctgctgtgcgtagatatatacgcccttatattcttctaaacccatttttggttcctccatactagatgatatgtttctctttgaatttctccatgagatagtttactgactctgttggatcaaggttaaccttttctccagctcccttaggtaccttgtcagatgccttagcaatctttgtaggtgatcccttaagtccaagatctgaatcgtcaacatccttaaggtcagctctgccccagacagttacctctttgtcaaatgcatcgaagattccgcccggtgtcatatatctaggctcgtttaactctgaaagagctgtgataagacaaggcatcttagccttaactacgtgatatctgtcctcgtactgacgcttaacgactacagaatctccctcaaccttgatatcctctgcgtatgagattacaggaagtccaagatgaactgcgatctgtggtccaacctgtgctgtatctccatcgatagcctgacggcctgtgatgattaaatcataatcgagatttcttaatgcacctgcaattgtagtagatgtagcccatgtatcagctccaccaagtactctgtctgttactaaaactgcatcatcagcgcccatagccattgcctcacgaaggattgcatcagcctttggaagtcccattgtaaggactgtaacctttgcgcctgtctcgtctttgattctaagtgctgcctcaagaccagccttgtcatctggattcatgattgcaagcattgaagctctatcaagtgttccgtcaggattgaattttactccaccctttgtatcaggaacctgtttaatacatactacgatattcatgtatttgttctcctttatttattctaagtagctctacagttatgatagctctcttaactatctgagtaatgagcctgaaataaccatacgctgaacctctgaagttccctcgtagatctctgtaatcttagcatcacgcatcatacgctctacatcgtactcacggatatatccgtatccaccgaataactgaacgcactctgttgtaacagccatagctgtctctgctgcgaataatttagcctttgctgcatctactgagtaagaaaccttagggttcttagcaaactctgccttcttcatagctgctgcgtatacaagatacttagctgcatcgatacgtgtagccatatctgcaagcttgaactgtgtattctgctgctgtgcgattgaacggccgaactgctttctttcctttgtatactcgatagttctctctaatgcgccctctgcaataccaagtgcctgagcagcgattccgatacgtccaccatcaagtgtatgcatagcgattgggaaacctcttccctcttttccaagtaatgcatcctttggaatacgtgcatcctcgaagataagctcgtatgtagatgatccgcggatacccatcttcttctcttttgttccgaatgagaatccaggtgttcccttgtctacgatgaatgcagagaagttcttcttcttgcgtccacgcttgtcctctgtgatgcttgtaatagcgatgatgatgtaaacatcagcaaccttaccgtttgtgatgaagcacttagatccgttaagaacccactcgtctccgtctaaaacggcctttgtctgacatccctgtgcatctgtaccagcgcccggctcagtaagaccgaaagcaccgatcttcttgcctgaagcaaggtcaggaacatattttttcttctgctcctctgtaccgaatgtcataataggatcgatacaaagtgatgtatgagcagatacaataacgcctgttgtaccacaaacctttgataattcttctacacacataacgtatgtaagtggatcacagccctgtccgccgtactcctttggtacaggaatgcccatgaatccatattttcccatcttagcaactgtctctgctgggaatacctctgtctcgtcagtctcctgtgcaagaggtttaacttctgtctctgcgaactgtttgaaaaggtcgcgagccatctcatgtttctgatctaaagtgaaatccatgatttattctccttgaaatttatattttgttttaatctcttttacattgcgtctacaggtgtctttgtgcggtctgcgttgtaaacgtagaatcccttgccgctcttgcatccaaggtttccgcctcttaccatcttgcgaaggagtgggcatgcacgatacttgctgtcacctgtctcattgtaaagaacgtccatgattgcaaggcagatatcaagtccgatgaaatctccaagctctaatggtcccattggatggttagcaccaagcttcatagctgcatcgattccggcgatatctgaaacgccctccatcttgatgaaagcagcctcgttgatcattgggataaggatacggtttactacgaaaccggcagcctcgttaacctgtacaggtgtcttgccgatctcctctgcaatcttcttgattgcatcaactgtctcaacaggtgtgttaacacctgcgataacctctactaacttcatacggtcagcagggttgaagaagtgcataccgattaatggacgtgtaagtccgtttccaatctctgtgattgaaagtgatgatgtatttgaagcgaaaatacactctggcttagcaatcttgtctaactcagcgaatgtagttttcttaacctgcatatcctcgaaagcagcctcaacgatgaggtcacaatccttgcagagatcttcttttaaaccaggagtgatgcttgcaagaatgccgtcaaccttctcctgtgtcattttctcttttgctacaagtcttgcatatccttttgcaatcttgtcttttccgccttcagcccactcctgcttaatatcgcagagtgctacctcgtatccatctacctgtgcgaatgcttttgcgattccctggcccattgtaccagcaccgataattccaaccttcattttaattcctcctaaaatatattatggtgcaaaaagctttaagtgctaagcctctgcaacataacttaatcatatatataaactgatgtgaataaactaattcacactacaaggggatgcacctgcaccccctcatatatctattggcaaagaaaattagtacttctcaacgatagtagaacatcccattccaccaccgatacaaagtgttgcaagacctctgttagatcctctcttctgcatctcatgtaataatgtaacaaggatacgacagcctgaagctcctacaggatgtccgagtgcgatagcaccaccgtttacatttaccttgctcatatcgaaaccaagatctcttgctacagcgattgactgtgcagcaaatgcctcgtttgcctcgataagatcgaaatcatcaattgtaagacctgtctttgcaagaaccttctttgtagaagctaccggtccaacacccatgatctcaggctcaactccgccaagtgctcctgctacccatgtagctaatggcttaacaccgagctccttagctttctcttcgctcattacaactactgctgcagcaccatcattgattcctgatgcgttaccggctgtaacaagtccgccctctttacctgagcagcaacgaagcttagaaagagtttctactgttgttccggcacgaggtccctcgtcctttttgaactcaacgatttctttcttaaccttaacaggtacaggaacgatctcatcatcgaacttgcctgctgcgatagctgcctcacacttctgctgtgagtttgctgagaactcatcaagctcttcacgagtgatgccgtatttatcacatacattctcagctgtgatcatcatatgatagtggttgaatgcatctgtaagagcatcgttaaccattgtatcgatgattgttgcattgttcattctgtatccgaaacgtgcctttgtcatagcgtaaggagccattgacatgttctccataccaccggcaacaacgatatcagcctcaccggccttgatcattgtagcagcgtcgtttacgcacttaagacctgatccacaaacaacattgattgtgatagccggaacctcgattggaagtcctgccttgatagaagcctgacgagctacgttctgtccctgagctgcctggataacacaacccatcttaacctcgtcaaccatctcaggagcaacacctgcacggtttaaagcctccttaattacgattgcacctaaatctgcggctggagtattgcttaatgctccgcccattttgccgattgctgtacggcaagcacttgcgattacaactttctttgccattatattatctcctttaaattgtattgcacatccgtgctgttaattttttaacaaagttattatactacaaatttatgtaaaaatcaattggttttgttaataatttgtcaaaattctattaaactttgcatatttttcacgcgtattacttatactattccgtcagattaacaaaagcctgtgctattataacctgctgctcacatgcaggcatgacgcatcagctttttatcaaattttttaataatcacaatttttacaaaaaaaatccccgggcagcatatccgctatactgtccggggataaaatatattctatatacttttaaagattcttaactgttgcaatatcaaccggtgtcttcttgtcagaagcagtctctaatgcatgcgcaagtgcattcgctgtatccatggctgtgatacagtaaacacctgtctcaattgcatttcttctgataaggaagccgtctcttgtcttgtctccgttaccctgtgtaggtgtatcgattacaaggtctatcttgtgtccgaggataagatccatgacgtttggagactcctgtgatatcttgtttacgcgaagagcatttactccgtgctcctgtaagtactttgcagtacttcttgtggcataaatcttgtatccaagcttctcaaaacgctttgcaacgcctactgcctcaggcttatcggcatcctttacagtcataatcatctgcttgtacttaggaagctcgactcccgcaccctcaaatgccttgtaaagcgcaccattgaaggtcttgtcgattccaagacactctcctgttgacttcatctcaggtccgagtgaaatctcagcgccacgcagcttctcgaatgagaataccggcatcttgattgcaatgtaatcggctgtcggagcaagtccaggtgtgtagcccatgccctttattgtctcacccatgatgattcttgctgcaaggtctacaatcggaatacctgtaaccttgctgatgtatggtactgttcttgaagaacgtgggtttacctcgataacatagatgttgtcgtccatatcgataaactggatattaatcataccaacaacatggagtgcctgtgcaagtctctttgtatactcaaccagagtctcttttgctttttctgagatagtatgtgcagggtaaactgagatggagtctcctgagtgtactcctgtacgctcgatgtgctccatgatacccggaatcaggatatctgtaccgtcacagattgcatcaacctcaatttccttacccataaggtacttatctacaaggattggatgatcctgtgtgattgtgttgatgatgccgataaactcttcgatttcatcatcattccatgcaatcttcataccctgtccgccaagcacgtatgaaggacggacaagtacagggtaaccgatctcgtttgctaccttctttgcctcctcagctgtaaatactgtaccacctgctgctcttgggatacctgtcttctgaagaatctcgtcgaagagctctctgtcctcggctgcgtctacatcctcagcctttgttccaagtatcttgacacccatcttcataagtgcctctgtaagcttgatggcggtctgtccaccgaactgtacaacagctccgtcaggcttttcaatattaacgatgctctcaacatcctctgctgtgagtggctcaaaatagagcttgtcagcaatatcaaagtcagttgaaacggtctcagggttgttgtttacgatgattgtctcccagccttccttggcaaacgcccatgtacagtgaactgaacagtaatcaaactcaacaccctgtccgatacggataggtcctgaaccaagtacaagcacctttttctgtggatttgtctctaccgcctcattctcgctgccgaatactgagtagtagtatggtgtctctgcttcaaactctgcggcacaggtatcaaccatcttgtaggctgccacaatgccgttgtcgtaacgcatcttcttgatatcagcctcatcaatatctgtaagctgtgagataacattgtcagggaactcgatacgctttgcctcttttaacaggtcaactgtaagctcctctgtctttaaacggttctccatctcaacaagtattgcgattttatcgataaaccaaagatctatcttagtaatctcgtgaatatgctcgtatttaactccacggcggagcgcctctgcgataacccagatacgtctgtcatcaacaactgcaagctgtttctcaagctcatcatctgtaagacctgtaaagtcataagacataagtgaatcaacatgctgctcgagagatctgatagccttcataagggcaccctcgaagttgttgcagatactcattacctctccggtagccttcatctgagtggtaagtgtacgctttgctgtgaggaacttgtcgaacggaagtcttggaatcttgactacacagtaatcaagcattggctcaaagcttgcgtatgtcttctgtgtgatagcgttcttgatctcatcgaggtgatagccgagtgcaatcttggctgtaaccttggcgataggatatcctgtagcctttgatgcgagtgctgatgaacgtgaaactcgtgggtttacctcgataacacagtactcgaatgagtcaggattgagggcatactgtacattacagcctcctgtaatctgaagctcgttgatgatattgagtgctgatgtacgaagcatctgatactctttatctccaagtgtctgcgaaggtgctactacgattgaatctcctgtatgcacaccgaccgggtcgatattttccatgttacatactgtgatgcagttgccgttggcatcacgcattacctcgtactcgatttccttccatcctgcgatacatctctctacaagaacctctccgacacgtgacaggcgaagtccatttgaaagtatgtcgataagctcctgctcatcgtgagcaattccaccgccggaaccgccgagtgtaaatgcaggacgaagaactacagggtaaccaatcttgttggtaaatgcaataccgtcctcgatattctttacaacctgtgaagccgcgattggttcaccgattttctccatggtatccttgaaggcctgacggtcctcagccttgaagatggtctctgctgttgttccgataagctttactccctgctcatcaaggaagccgcactcagcgagctccatgccgagattgagtcctgcctgtccaccgagtgtaggaaggatgctgtcaggcttttcttttatgataatctcttttaatgactcaagagtaagtggctcgatatatacctgatccgcaatctgcttatcagtcatgatagttgccgggtttgagtttaccagacatacctcaacgccctcctcttttaaggaacggcaggcctgtgttcctgcatagtcaaactctgcggcctgtccgattacgattggaccggaacctataactaatacttttttaatatcattatttcttggcattactggttacctcccatcatgttaataaagcggtcaaaaagatatgctgaatcctgtggtccagggcatgcctccggatggaactgaactgtgaagatattcttgttcacatacttaagtccctcattagtgccgtcgttgacatttataaatgcaggctcagccacattagggtcaagcttatctgtgtcaaccacatatccatggttctgggaagaaatataaacacggcctgttgcaagatccttaaccggatggtttccacctctgtgtccgtacttcatcttgtgtgtatctgcgcctgttgcaagtgccatgagctgatgtccgaggcagattgcaaaaatcggcacattgctgtcataaagcttctttatttcctttataatatctacacactcctttggatctccaggtccgtttgagagcatgattccgtcaggattgtcaccaagtatctcttcagcggttgtgtgtgcagggtaaattgtaacttcacagcctctttcattgagtgatttggcgatgttgtttttggcaccgaaatccatgagggcaaccctctttccttggccctttaaaacctttttctcagtgcatgtgaccttgtcaaccacattgcctgtagtatatgccttgagctttggaataatctcatcgagattgtaattctcatttgtggtaatcattccgttcatagtacccttttccctgagaatctttgtaagcgcacgtgtatcaatgccggccactcccggaatatcgtttttctcgaggaaatcctgtatagtaccctcgcagcggaaattacttggcatacgcgacagctctcttactatatatccatccggccatggtctttctgactccatatccggtgtgattccataatttccgataagtggataagtcattacaacagcctgtcctgcataggaaggatctgtaagtacctccagatatcctgtcattgatgtgttaaatactatctcactaatgacttcccttgttgaaccaatgctggttccggtaaatacattaccatcttcaagaattaaaaatgctttcatctttaccctgccctttcgtgttatactttgtaaccataagcttcttagctgcaactaaccttacgtctgcgcaaaaaaaaagagggcgtctcttttttcttataaagtgtagttgcatagtatatctgcttaaattgtaaaaagtgtatcataatacagccgatttttcaactgttttttgttacataaatatgcatatttatgtatacaatattagttactgttcacaccaaagtatgaccggcaactattgtagcccattaaaactgcatctgagcgttacggagtaagccccgcgcataccgcatatatcagtcctgaaaaaaatacaaggcatgtaaagccaactgaaattgcaataaaagtcttatcagctatatgtcgcggtgtatactccacctgatatatgctttttgctgtcataggaacgtacatatcgccttgtccattgcaaaagcctccctgatatgcactcttaaagcccacacgactgaagtagtctgccgtgtatgccggcattgcatttacagacacctgcatgagcttaagctgcatgcgcgcatatatcctgactctctccagaagctttttgccaattccacgtcttaaatactgcggatgcacatacagcatggtgatatgcccctcgtttgtcatgccgcacactccgcacagcacattgctatcaaacgcaccaaatactacaagaacaccggccctttcctcgtccgtcagcctgtctgcatccatatattcatcaaaatatcgatgacagtcctgtgtccgaaagcagcctctgattgcgatattgtatatacttaccgcaaaggcacatgccccttttatctcttcatttgtaagttttcttattttcatcagatagtctcctccactattctgtctctaagcccactatagcgtctctgctgtgagttgttttgtatcatctcataaaatgtctgttcgtcacccactatggtaacacatttctttgctcttgtaaccgccgtataaagcaaatttctgttcataagcattctcgggccgctcaaaagaggtataacgaccgccgggtactcacttccctgcgacttgtgtatagtaaccgcgtatgcaagttcaagctcctccaaaagcttaaacggatactccacctttctgccctcgtcaaatgatatggtcatggtctcggcaaaatcgttgatttcctcaatgatacctgtatctccattgaagattcccatgcccttatccacacaaagtccgaattttgtcctgatttcccactctatctgatagttgttctttatctgcatcaccttgtcgccctcgcggaaaatcgtgcccctgtattctttttcgcgcttgctcttgtctgccggattcatatacgcctgcaatataccgtttagacgttccactccaaggagtccctttctcataggcgtaagcacctgtatatcatactctgtagcatttacaaacttgggaagcttctgctttatcagctgtaatgtaacatttattatcttgtcggcatcatatctttttagaaaaaagaaatccatgctcttattatctaacgatacatcttctccattatttatcttgtgggcgtttactataatatcgctcgtgctcgcctgacgaaaaatctttgtaagctttaccgtgtggaaggcgcctgaatcaataatatcctttagcacgctgcccggtcccacgctcggaagctggttcacatctcctacaagtatgagtcttgtacctgccacaaccgcctttagcaatgagtacatgagtgatatatcaaccatcgacatctcatctatgatgattacatccgtctcgagcggattcctttcatttctctcaaagccagctgcgcttcctgtgtccatgccgccgtttaactcaagcatacggtggattgtgcgcgcctcgtagcctgtcgtctcactcatgcgttttgccgcacggcctgtcggtgcagccagaaaaatatccatgccctccagctcaaaatacttgataatagtattgatagtggtggtttttcctgttccgggtcctccggtaatgactaaaaggccatttctgactgcttccttcaccgcctctacctgatgctcatcgagctccatctctgtctttttctctatatttctaattgcagcttctatctcgatatccggcacatcatacgtcacatcaagctgctttagcatggctgccgtgtttgcctccatataataaaaggtgttagcataaatctgggttatatcatcctttaactgcatgacaatcttcctgtccatggccagattcatgtaatgtgcctcaacctgcgagctttccactccgagcagatatacagcacgcctcgtaagctcctccatcggcagatatgtgtgtccgtccatggcagcctgctgcaaaacatactgtataccgctttttattctaaaatcagaatcagtcttgatgccaacccgcgccgctatctcatctgcagttttaaaaccaactccgtcgatatcatccgccatgcggtacggattttccttgagcacgctgtatatctctccgccatacttattatatatcttcacagccagattcatattgataccgtactgctgcaaaaaaatcatggcttcccttaagtctctttttgcattgacctggtccgcaatctccatagcctttctctggctgatgccctttacctcagcaagcctctccggctcttcctctatgatgcggaaggtatccttcttgaatcgcctgacaatacgtgctgcgagtgcaagtcctataccatgtatggctcctgagcccagatacctctcaatagccatctcatcctccggctccttctcttcaaagcttactaccttaaactgtcggccataggtggcatgctctgtatactcaccgtgagcctctatattttccccctcagcaatgtccgaaaaagtacccacacatgtgagctcctcctcgttcactacaagaacaagtaccgtatacccgttttctgcatttctgtatattatatgatcaacgtatcctgtgactgtttcggtttccaattgaatttctccgtatctgtgtgtttttattgtgactctgaatagttttatttttttaatattataccctagagcatgcgtatctgcaattactaagtttgcactaaaaaagccggtaaccacatgcaagcatgccgaaccggctttttattatcagttattatgaaatattgtaattgcgcttcatctgctcataaagctgctgtgtgatgttctctccggacttctccactatcgtatcactcatctgctctatgacattgtccatgaacatatccttgtactgcgacatagaggaatcctcatcatcactctttagtgtcatggaatccttcatttcctttatgacctgctccacaaaataagactcaaaatctttaagtgtgctcttgagctcgtcctctgtagagtctgatgacagattttttacgttattcttaagcttgtctgccaccgcagatgtattatttgagtttgcaagtgttgatactgcgcttatatccatatgctactatctcctcaaattatttgctgtctcaagcatcgaatcagctgttgtgatggcctttgaattgagctcgtaggcacgctgtgccacaatgagattaaccatctcgtcagctacctgcacatttgagccctcaagatatcctgtcacaaccttgctgtttttaagagctgggtttgcagcttcaagcatcggattgcccgaattggctgttgctgcaagcaggcttcctgactgcttttcaagacctgacgggttattaaactgatacacagcaattcgctgattcagattaatataattgccctgtgcagtcatataacctaccgcaccatcctctccaaagctcatcttctcagcagacacacctgccggcacagctatgatattaccgtttgtatccatgacaggattgccctgtgaatcagtaagtatagtctgtccgtttccatactggctccatgtgaaggcaccgtttctcgtgtaataggtctgattgtcagtacctctcactgcaaaaaagccatcgccctccaaagcaaaatcagtaggcctctccgtagaattgagcggaccctgagtataagtggatgtggttgcagccacacgggtaccaagccccacctgcgctcctaccggctttgcatcaccatttccggatgtagaacgggtctgtatcgtctgatataaaagagacttaaactctgtcctctgacccttaaagcctgtcgtattgacattggaaagattgtttgcaattgtatctacatttgtctgctcagcacgcatacctgttgcggctgtgtaaagtgccctcatcatatggcatatctccttatactcttcctacattgttgacagccttgtctaatgtctcatcaatagatgtaataaccttctgtccggcttcatatgcacgctgtatcgtaatcatattgaccatctcattgaccacattgacatttgaagtttctaaggctccctgttctatttcggcatcggaagctataatattacccccgaccgtcagattgtagagattttcaccatatttttcaatatagtcataattatccacatcgacaacgcctattgtgccaactaactgattgttctgtgtgatatatccaagtgagtttaccgaaaacttctcattcgggtctacctttacccagtttgcctcaccgccatctccactcaatgcacctgtcgcattgagcacatggtctccgtctgctgtgaccagataaccgtcagcattgaccttgaaagcaccgtctctggtatactttacacttgtctgaccggatttgtcagtaaatgcaatggcaaaaaagccttttccaccgatagccaagtctgtaggattgtcagtcaccttaaagctgccctcatcccagtcggtatatgtctcaccgagatgcactccgtatgtcatgctgcccagatttttgtgcagtccgtagtttgatgtatcctttatctttatagcaagttcatttttaaatgaatgcgaggtggttccctcttttttaaatccataggtatcggaattggccaggttgttcgcaagaacatccatgcgcttcatctcattaaccataccggtgtgagcggtgtataagccttttaccatatttttgtcctttataatctgattctgttgataacgtttatctttgatgccttgtcggcaaaatccttctctgtcatgtcgcctgttgtgaatgcatactcgccgtcaaccacatcctcaatgtagtctacatgtccgaatacagcctcaacctcgctctttggtgagtcagttctcacaaagaagctgtttacactgtcatcatagcttacaagtgtgagcttctcaggcttccagtcgatataaatatttgtgttctgatgctttgtcatatcaacaacatctgccactacagcacttgctgttggaagctttcctgctccactgccgtagaacatagcatctccgagcacatttccgcgtaaaaatacgccgttgaacactccatttactcctgagagcggatgtgtgtcatctatcatatatggtgcaacgagacaggtatagctgtcacccaccttgcggcttgaagcaagaagcttgattgcacggtgcattgcctttgcatacttaatatcctcaggtgtaatctttgtgataccctcacagtggatatcctcgaaatccacctgctgtcctgcaacaagcgatgtgagaatggctatctttctgcatggatcatatccctctatgtcggctgtaggatccttctctgcatagcccttatcctgagcatcctttaatacctcatcaaagtctgcaccttcctctgtcatctttgtaagcatgtagttggttgttccgtttaagatacctgtgatttcctcaatctcgtctgctgtgagacacttgttgagaggtctgataatagggattccaccaccgacactggcctcaaactggaagttcactccatgatccctggcaaccttgatgagctcagcaccctttgcagcaacaaggttcttgtttgatgttgctacctgttttcctgcctcaagcattgcctttacgaatgtaaatgcaggctcaacgcctcccattgtctctacaactataccgatttcagggtcctctgcaataaccttataatcatgaactattttgttctcaataggtgtacccgggaactctcttaaatcaagcacatacttgacctcgattggctctcctgctctctttgcgattttttccttgttgatttctaatacttctacgacacctgatccaattgtgccgtaacccataactgcaatcttcatctttttgttactccctggctaaaatttttacgtaatgtatgccctttaaggactcaatctgctttgccatatcatccacatcatccgactccggaaatacatccacagataacgtgagtgatgcaatgccatttaccggtacactttggtgtatggtaagaatatttgctttcgcatcggctaccgacttaagcacaacggaaagtatgccctgctcgtcatccatctgaatgacaagattcactgtctttcctttacgcccctcataaaaagggaaaatatcatccttatatttgtaaaaggagcttctacttatgccaacagcatctgttgcctcctgcacagattcaagcttgcccgaatccagcagtctctttgcctcaactactttaagcagcacctccggtacagcctttgcccgtaaaacgaagtagtttgatttctccgccatttagttacctccaaaatggccggtgtgtgtttgtcacacaccgacatttgtccttgactcaaagattttaacacaaagattacagctttgcaacatcttatgctcttggttttccacaattactgcagaatttacctgtatttttttgtccacactcacatgtccactctgtgtttacaggtaatggcttgccacagtttgtgcagaatttacctgtatttttctgtccacactcacatgtccactctgtaatctcctgtggcataggcttgccgcaattactgcagaatttacctgtgtttttctgtccgcactcacatgtccagcctgacgcatcctcctgctgtgtggcacctgaagccactcctgctaccatacctgctgcaccatttcccggcgcattcattccggctgacctgttattttgtgccatctgtgtaaaaccattcatcatattgcccatggtgctcattcccatgccgacacccatgaagccctgcatagctccaccactgttgctgcctgcattcttgacaccctctgacatatttttgaccatatatccctgtgcaatagatggatctgagagcattgcgccctcgtttcttgtgttaatgagctcctgagacttctcatcatatgaaaggctggcgataccaacactttgtacctccataccacgcatctgattccagctttcatcgagacacttcgccatatatcttccaagctcagatgccttgcttgtgacgaatgaaattcttgtaccatccgctgacatctggttgatggcagactgtaatgcctctaaaaactctgacagatactgctcattgatatcagtaatctccacatgatccatattctttggaatagcctctgcataaaactgaagcggattcacaattttgatggaatatgtaccatgggcacgaaggaaaagctccgcattataaaatgtatcatagtagtttataggatttctcgtaccaaacttgattcccttgatttcctgaaggttgatataataaaccttctgtgactgtggtgtctgtccaccaaatctcacacggtcaaaggtttcctttaaagaatccccaaactgtccgttgaaaagtgatggcatagatgaattgctcaccttgtagtagcccggctcagctgtgtaatccacaatcttgccaccatcaacaagtatcataaactgattgtcatatacatgaatgatagagccgtttgaaacaatatcgtcagagccttttttattctgccccctgtttaccagcacacccctggcatagactgtctggtcgcctatattatccggctcaataacctcctgccatgtatctgcaaagccgcctccaattgcctgttttactgccttaataattcccattttcttcctccttagatatggttgtaatcaacttcatgaaagctctgcagcttccatacttttatattgacaggctcaacatatgagccacaatattcacatttctttgctccaagacttctgaccggagcaccgcaattcggacatgtagtgccaactgcactgcctatccctgcattatccagcatatctatatcctgtatgtatacaagctccatattgtatctggtctgctttttatactctttatcaccactgataagctttcccgaggcagtcttgtagtaaaaatactcaaccgcactctgtatactgatgacgcaccttccatctcttttcacatagtttgagatttcagtctgatgcaccctgatctcgtcaaaatgctctgtaaaaccagccgcttcattgctgtctatacgcaccagcacctgctgtcttacctcatcagaagcctcacggtccagcttgtaaatatcctcagtcgtgattgcacaaagtgctgacacaagcactctttctgacattctcttaaactgttcccagacaaactctggaaaatccctttttatctgtggctccataaggcgcgtcatgcctgaaaccgacttgggagtcgtagagacattctccctgatacgattgatgccctctgtgacatcaggtgtaccaagaagactttcagacaaccgtctgactttaatgtaaacggtcactccggcagctgtcagaactgctaatatcgccacagctataactaaacccacatttgcctccttattctgaacgtgttgcaagccacttcaaataaccattgataaatatatctatattgccatcgagcactgcatccgcattaccggtctccacatctgtcctgtgatccttgaccatggtgtaaggctgaagcacatacgaacgtatctggcttccccagccaatttccttgacctcgcctctgatgcccgcctcctttgcagcattctcttcctgctttaaaagatacagctttgcctttaacatctgcatggctttgtccttgttcatatgctgtgaacgctcattctgacactgtaccacgatccctgatggaaaatgtgtgatacgaatagcagacgaagttttattgatatgctgtcctcctgctccacttgagcggtaggtatcaattctgatatcctcgtccttcacctcaatatcaagatcctcctcaatatcaggcatgacatcacatgatacgaatgaggtctgcctttttcccgccgcattaaacggcgaaatacgaacaagcctgtgcacacccttttcagactttagatacccatatgcattctctccgtttacctggaaggtaatggacttgataccagcttcatcgccatcaagcgaatcgagtacctcaagggtaaagccctttttatcagcccacttcgagtacatacgaaacagcatggccgcccagtcacacgactcggtaccacctgcacctgcattgagcctcagaatcgcattgcatttatcatattctcccgacaaaagagtcttcattctgataccgtcatatgtgctctcaaaatcatcaagcatctgctgtatctcgggtataagtgactcatcgttctcctcatagcccatctcaatcatcgtctctatatcttcgtactgttccttgagctttgcgtatgtagctacatcatccttcatactcttaagctctttcatcttgctctgtgacttctccgggtcatcccagaagtcaggagcttccatttctcgctctaattcctggattttttcttctttattagccaggtcaaagtgaatccctcacttcctgtagtggggctttgtagccttggagcgtggacttgaaattatccaactctaccacagaatcacctctttctttgcattttttgatgacgcttcccgcatcaggttgtgcggttcggctggcacacagtatattcctctgaaaaatatgaagtcagccacgggatttttttcggatagtgattttttattttcactttgtttcatttatatttttaatggaaccccgtggcagttcatatttttcttcggaacatgctgtgtgccggccgtaaacctgggtttacgtggcgggaagctggttgtggcaggaattaaatatatatattaagtctgccatgtatcctctaaccagcgtcattatttttattataccgattaaactaagaaactgcaactaaatttggcacttctcttcgtgtcttcatgttttcatattttcggttttgcagtgcctgctgtatgcctcttacgcgccacatgtgtaacaagtgcaataaatagcagcataatgataccgcctgtggtatcaatcagtacgtccgtgaatctgccggcccggccgggaacgaacagctgatggatttcatctgtgcaggcatacaggaaggtcacgcctatcggaatcacaaatcttcttctgccatgcaaaaacgaaaatgccacatatccaagcaatgtgagaatggcatactcactcatgtgggcacattttctaaccggatagtctataagctccgccttatcgagcagctccttctcatcccagtggcttgcggtaatggtattgaccacagaaactatgcgatagctgacgctgccgctgagctcagacgactcggtatccggctccgccgaaaacataaagatgactaccatccagcacagcatgagaaagcatgcaatcttatttaagcttttcattcatcacctcaatcgctttctgaatctgtacatcatacttcatgtcatagtctgcatttgtatctcctgtatattcataatcgacctctacatcaggctcgataccctttttgtggatattgtgaccgtttggtgtgtagtacttcgatgtggtaatctttacagcatcgccatcggaaagattgtagatagtctgtacaattccctttccaaatgtctttttacctacaagtgtggcatcaatataaccatcctcattgtaatccttcatggctcccgcaaaaatttcagatgcacttgcgctgttttcatcgacaagcactacgataggacagtcaatctgttttccatcgtcatcaccaaatgtctggatatttccgtttttatcctttgtatacacgacagttcctgccggaagcttgccaactgtttctgcaggaagcagtctgtcaaccatttctgtcactgcggtaagtagtcctcccggattagcacgcaaatccactataagacccttcataccctgatttgtaagtccgtcaagtgcatcctcaaactgacttgccgtgtttgtctgaaactcgctgacctggatatatcccactccattgtcaagcagcttgctgtccactgatggcagctcaacatttttacgctccacctcaacggtaaatgggtcagcctccccgccacgcctgatttcaagcgtaactttcgtgccctccttacctctgattttggcaacaagctttgtgagatcctcggatgttgcctcgacaccatcaacagagactatttcgtcatcctttttaagtcccgcttcctcagaaggtgtaccactgtataccttcgaaactgtcacctgctttgtattcggatcctgctttaacgcagccccgattccataatacgtgcctgtcgtactaatctgcagctccttatattcatccgcggtataataaaccgaataaggatcatttagcccctccatcacaccatgtagcagaccgttttccaaatcatccttatcgtaatcctcatagtaatactcgtctatgtagttcgcaagctcatcgattttctgcacggtcttgtcgtcaagcacatctgcgctttttgcaacggtatgcacgctcctgcctgtaatcattgtgtatgcaaagagcacaatcaatccaagcacaatggtggtcactatacctgtagcaatcccgacaccgaacccatttctaaatccctttctatgaggctttttatcgctcatatctgaattatcatcgtattctaagccgttgttgtttgaattatccatttcagtcctgtcctctctatattatgatatgaacttaaaacagcctgtctccgatcggagccaggccgtcataattattattatactcttaaatgtttccgaattgtgaatcggcttcccaaaaagccaattccaacgcccagtataagcgctaccggtacaagtgtagagaaaatctcctttgtcgggataaatgtcatcatatttcctataaagctaaacttattagcaatatatgcacaaatctttccatacatgacactgagcaatcccagaggaatcgctgatcctatcagtccaatgagaataccttctaccacaaacggagatctgaccagaaaatcagtcgctccaataagcttcatgatagctatttcctctcgtctgaccgcaatacctgtagtaactgtgttgcttataaggaaaatcgcaacacacagaagaatcaaaatgatacctcccgatacatagctgataagcttatttaaatcagtcagtgtattggccacatcctgcgactggtttacctttctgacgccctccagccccttgatatagttgacaagagtctgctgcatagagacatcattcaaataaacctgcagatttgctgaattactgagagggttatcatcaccaaatgaagctgcagcatcatcgtagccctcaaaatactccttctggtaatcactccatgcatcggccgccgactgataatccaccttgccaacctcagccctcttttctatctgagccttgtccgcttttattacatcctctgtagtgccctcattaaagaacactgtgacagcaacaccctcctcagctgtcttaaccatgcttgagaagttagtcacaactatataaaacagaccaaacataaaaatacaggctgccattgtcgctatggatgccagtgaaaacatcttgtttctgaatatattcttaaatccctgcttgattgaataaaaaaacgtattaatcctcatcactatcaccatccttgctgtcagatacaacaagacctttctttatagtgataacacgttttttcataaccttaacaatctcaagattgtgagttacaacgataacagttgtgcctttctcgttgatttcctcaagcagtttcataatctcccacgcattgttattgtccagattacccgtcggctcgtcagcaagcagcatgctcggctcattgacaagagctcttgcaatagctactctctgctgctctcctcccgaaagctccctcggctttgacttgtactttgcagcaagccctaccatagaaagcatctgtggcacctttttcttaataacagctgtggatgcaccgataaccttgagtgcaaaagctacattttcataaacatttctatcctttaataatctgaagtcctggaaaacgactccaacatttcttctgtatttaggaatctgcttgtggcgaatacgcgtcagattccttccgtcaacagtaatcgttccgtctgtaggatcaagctcctttaaaagaagcttaatcaaagtggatttgccggatccgctatctccgcatacgaaaacaaactctccatcatcaatctcgagattgacatcattgagagcaggtatacctgcagaatatgccttactgacatgttcaagtttaatcattactttctccttaatagtccattgattccatatatttcatatatttgactaccataagggcaatcttaaatgtgatggcatcctcgaacactctaaggtcgagccctgtacttttctgaagcttgtccaatctatatacaagagtatttctgtgaatgtagagctgtcttgaagtctcagatacattcaggctattctcaaagaacttatttatagtagataatatttcttcatcaaaatcgtcaggggatttgccatcgaatatctctttgataaacatcttgcatagaggaatcggaagctgatatatcagacggcctattccaagctgggaatatgctataatattcctctcctcgaaaaagatttttccgacatcaagagccatcctggcctccttatatgagcgcgacacctctttcaactcattgataacagtaccatatgcaatatgtaccccatccgcttcggatctgaacagattcaaaatcacctcggctgtctttctgagatcatcataggtctcgttttctgccagttccttcactactattatattcttctcgtcaacagctgtaacaaaatcctttgatttgccgccgaaaagacttctgatcttctcaagctcgttgccgtccttctccctgtttgtctcaacaataaatactacacgtcgcacttcaatatcaatatgaagcttcttcgcgcgattgtatatatcaaccagaaggagattatccaaaagcagattctttataaaattatccttgtcaaatcgctccttgtacgcaaccagaagattctgaatctggaagcttgcaatcttgcctatcatgtagacatcctcgctgtcaccataagctaaaagcacatattccagctggtgatcatcaaagactttgaaaaactggcatccattaatcacctgactgtctgctggtgatgcaacaaaggcctgtgccggctctataaacgcctctgcgttcggaaatgtagctgcaagaatcttgccctcaacatctatcacacaaagatcggttctcgtaattcctttaaggccatcaattgtattttgaagtatctgattggaaatcataaatcgttctccttctcccctttttgtaactgtgcattgccctcacagtcactttataactaattgcataaatacttgctattattttaatacattcgcacaaaaaaataaagaggtaaatgtacaatttttacacatttcctcttattttttcttttattgttataagaattaactatattgaactgttttgtctatgttcataggtgttgataagatgcgtaaggtgcttcacatcaagcatttttcttatttttccaataaatccatgctttttccccatgaacttattatttccgattccgtaccagaggttcatcaacagcttttccctgttgtgtaaaaggaacttctcctgtgacggagacggaagaaatgatgcaatcgcatcaggtgaaacgatgttaatttcattgacaagattttcgctgcatcccggtgagtcatcaagaacacccttgccggatattcgcgctctgtcaaataatccaagcagaaattcctcagcctcatcaacagctttctgcgactctgcaatcacaaagatttttttatcatttctctcaagccgcttaaaaagctcataaaagaagtcatgatcttctatctcatgccgacgctgcaaggtatctgccgatgccgcccttagtatgccttcatccgcaatgacagtataatcgcatgcctccagcgcctgcttcacctcttcatcagactccgccaatgccagcgtatccatattcacttcctctattgtagtgagtatcttctctgaaatacgcctgtcgactctcatgagcatctcgcgtactgtatagttatcaagttgtagccctgcaatatctatctttttaatcataattttaagtataacaaaattaacttacataatcaacacttttcaagttgtccgacaattataaagcattttaatcatattatttacaattaaaatgtcaatattatttccgaaatattactaatttagtgcaactttatcagaactttacaaaacagttgttcttttgctcacattcaaaaatgtggataatgtgcataactccgtgcataactcatttttagggcactttgaggtttacttttgttgatagttatccacatttatccccaatccgaatttacctggtttagcatatcaacttttttgtgcatgttgctattttgatatatgtgataaaaattacgcttgacagccctgttttccattctgtttaaattagtcccgtttttaaacatatatgcatatcatacaggctacttatttcaaatatcataaacaaaaataaattttctatatgtaaaaaagacctccatctcgatgagatgaaggtctttatagattcatatttacctatccggcatgaatttattagaaaattcttctaactgcaatgattgatttgtagttagccggtgatgtatatttgataccgtctgatggattgcttgcatgtacaatagtgtttccaccacagtagatagcaacatgtccgctatagcagatgatatctccaggctgcatatcgcttgtgctcacaccgtatccaacgcttctcattgctgatgagctgtgtggtaagctgatgccaaactgtgcataaactgacattacaaatcctgaacaatctgttccgtttgtaagacttgagccaccgtaaacataaggattgccaacgaactgtgatgcataattaacaacagcctgtccgtttgaaccacttggtgcgctatagctcttctctgatgaagaactgcttgatgatttgcttgaagacttagatgacttctttgctgctgccttggctgcttttgcttcctcagcctttctagctttctcttcagcctttctggctgcttcctcagccgccttacgctctgcctcttccttggcaagtcttgctgcttcctcttccttagactcagcataagtgaactctgtatcgagtgtcacataatctgtagatacatatccggtaccgtctgctgtagatacacctacccatccagctgttgactcatccacaactgtgagatcatcctctccggacacgagaccaagtacttctgcatcagtagatgctgttgttctgaccttgagtgtctcagtattgactgttgccacgcgacgtcctgcgctctgtacaagtgcatcgtcaccaactacaacataatcgccttttacatatcctgttactgaaccggactggattttgtaccatccgttatcggttgtctcaagtactgttccaattccattgttatagagctttccaagagactcgctgttttcatctgcactcgcacgtatattaacgctgtcgctaacctgtgcaactgctgtatcagcatatgctgatttaaccggctcagcatctgttgccgcaacatctgttgcagtctctgatgtctcatcaccttttaacattacatctgtcaacatagatgtaacaccggctgtaagagtgtttgatgtactaacaatatctgatgtataactagctactcctgcagtaggtccagccgcatatactgcatatggcactgaggacagagccataaaacctgtaagtaccccggctgtgagtttcacataatttactttcattttaccctccgttgtatgaatttgtaacagttattacgaatttgttacaaatattactttgtcattatagcaaagtaacatatatatgtcaacgttttcttagagaattcttaagaaaatcttgactttttccaacgaataggacttatgtcgcatgaaatacttatgtaataattttattttacagcaatagcctcaacctcaagcattacatcctttggaagccttgcaacctcaacacagcttcttgcagggtatgctccgttaaaaaatgtggcatatacctcatttattgcaccgaagtcattcatctccttgatgaaaactgtagtctttaccacattatccatgcttgttcctgctgcctcaagcagatgtgacagatttgtaaatgcctgctttgcctgtgcctgtgagccctcaggaatctcaccggtctccggaactaccggtatcactccggaagtatataccataccatttacctcgatagcctgtgaatatggtccgattgctgccggtgccttgtctgtactgataacgtttttcatgttattgtccttctttcctgttaaaatttattaaaaagactgttatttcttaagacggattttgccatctgtgagatcaatctttctttccttatataaatgaccaactgcacgcttgaatgcatttttgctaagtcctgtttctctcttgattacctccgggcttgccttttccgaaaacggaagcacccctgcgtatgaatcaagcagttcaaggagcttttcagcgtcggaatccatctgaatatatgccttttccctcattgtcaggtccagcttgccatccgccttgacatcagtgacctttgcctctatcacatctccaagcttcagataagcggcattctcaaaaaccggtatcttggctgaatatttgtcatccacagcgataaatgtaccgaaattgtcgctaaaatcatacactcggcctgaaaccatatcgtcctttttgtatggcgaatcggtgctcagcatatggtaaataccctttgtggtagcgcaaagcctctggcttttatctatgtataatgtaacaagtatctcatctccggcgctgacctttctgaccatctccttgtaaggaagaaacaggtccttttcaagcccccagtcaaggaacgcccctattttagtcacctccttgacagtaagcactgctaaacctccaagtgtcagctttggctcgtttgtcgtagcaataagtctgtcgttagagtccttgtatacaaagaccttaagcttatccccctgctttactccatccggaatctgctttgccggaagcagtaccctttcctccgaagccgaagatgttgacagatatatgccaaaatcaaccttctttacacatacaagctcctgatattctcctaatctcatgtttttccgtcctttctgtatcaaaactgtatcgttgttaaataatggaattataattattttcccggtaccggcttactcaaaaactccaccaccgaatacggttttttatccgtatccgcaagcaccactgtcacactctttgatgtgtacttcacgtatgatataactgtatcaccaagctttgcttcttttctgtactccacacgaagctcagatatctcaaaatcattcggcagaagctgctgcgccagcataacatacttctcattgttcatatgatggttgctgtctataaaaaactgaggaaccacaatctcaccctttttctccatatcatcaggaatatgaagcttgcgctttgcacactccatctcaagctgcggctcaagaccgtatgtatccgcaaactcctgaggcaccttcaccggtctgccggttcgtgtatcaacaagcacccagacagaattggcatatgccagtgtgctgccgcctgcatcttcaagtgtgaaatttctgtagccgtaaaacgccttcataccatatgcccatgtggatatctttacctgttcattaagcagtggaagcctgtttatgcatatctgccatgatgaaagcacccatgctatatgattgtccgcaagaaatctgattcccacatcatgtgactgtgagtgaaacacactacagtcctgaaaataattggtaagccccgtaaggctcagtctgcatgacgaatccacctcgctgtaacgtattctgctgtcaaatgaaaaagccatatctaattcctctagtctataaaattgaagtaacttctgataaatctaaacgcttcatccacaccattggacatccaaagatttgagcttttattaatgatatcctggtattgctgtatagtaattggtgtctttttttcagagccgagttcttctataagattaataattctcaaaaaattcttgttcatattacaccatccttctataactgtttaagtcatatacgtttttattttataacaaatcgcattattacacaagaaaaaaagagaacttctatcgaagttctctttagctggcccacaaggattcgaaccttgaaatgacggagtcagagtccgttgccttaccatttggcgatgggccaatgtgttgtctcaacaaatgatattatacacatgtgattatatagtgtcaagcatttttttattttaattgaatgtaattgaatataaattctgcttgtcctgctaaaatgtgagcaccggctaatttttaaacagcaatacctcgccatcatattcagcaaatgtcacctcatcgccccactcaagctttgccgtgccgtttgtctgctctatgattgttttctctatgcgttttttatcattttccgggataacagctttcacgagcacatccgcctcatacgctgtgtccatcaccgtaatcttctcctgtgcaaacagatactgaagtcttccgattccggtatagtccgtcctgataaacagtactgcaccctccttcttctctattatctcacttgccgaaagccccgcctttgtggcttgctgatacgcacgcaccagtccgcctgtgccaagcagcaccccaccgaagtatctcgttacaacaacagcggcattgtggatattttccttaagaaggacatcaagcataggacggcctgcggtgcctgcaggctccccgtcatccgagcatctggtcagctcctgtctctttcctataacaaaggcactacagttgtgccttgcatcccagtatttctttttcgtctcattgatgaagcttacagcctcatcctcagactctaccggccttacggttgctataaacctcgatttcttctctgttatctcaccctgtccgcccttgtacacgtacaggcttatagtattctctgacatatgatattctttccatcctgatattgcctgattacaatcatgcatcttaaagacactttataattgttacctgtattatataatatgaaaaccaatctgtaaattgcatttaaatgctatatttgatataataatgtatactgtttattttctaatcacagtatatacaaacaagattacaaatctttataatgacaaggaggcctatatatgaattacggcaaaaaagctacaatgcagctgctccggaaatatgacaataagagctctaaggtcaaaaacaagttcaagctcattgttctaaagattcttctggttgtagtaattgtagcaggcgcagccggcatcagttcaggaatcggtgtcatgaagggaatcattgattccgcacctgacatatcaaagatcgatgtcactcctaccggctactcaactaccgttctggcggcaaacggagaagaaaccgccacactcgtaggtcagggggcaaacaggcagtatgtcaccatcgatgagattccgctggatttgcagcatgcttttgttgcaatcgaggatgaacgcttttacgaccacaacggcatcgacctgtatggtatcggaagagcctttatctccggtctgtcaaagggcagattcagtgagggagccagcacgataacacagcagctcatcaagaacaacgtactgaccagctggacaagcgaaacttcctttgtagaaaagcttcagagaaagattcaggagcagtaccttgcccttgagctcgaaaagcaggtaaacgacaaggactggattcttgaaaactacatgaattcggtcaatctgggggcaaataccctcggtgtgcaggctgcatccaagaagtactttaacaaggatgtctcagagctcacgctttccgaagcatctgtcatcgcaggtatcactcagaatccatccggctacaaccctatcacacaccctgacaaaaatgccaagagacgtgaaaaggtgttaaataacatgaaggatcagggctatatcaccaaggcgcaatatgatgaggccatggccgatgatgtctactcaagaattgctgagtacaacaccacaggctcaggctctgtgaacacatactttattgatgcgctcatcgacaacgtgttcgacgatctcacagccgccggttactctgagacagaagcctacaagctgatttacaagggcggactgactatcaaatcgacccaggatcttactatgcagactatatgtgacgaggaggcaaacaatccatccaactatccgtccgatgcaaagtattcgttccagctttccttcgaggtaaaaaaggcagacggttcgtacaagacctacacaaaccagaccatgctctctttttataagaagaaaaccaacaatgatgatttcagcatcaactactcaagccctgatgaatgcaatgcagctattgcacagtacgagcaggatgtacttgaggagggcgattcaattgtggagggttctgaagctgtcaatatcacgctggagccgcaggttgccatgacagtcatcgaccagagcaccggtgaggtaaaggcactggtaggcggtcgcggtgacaaatccggcaacagaacatggaacagagctacagatacatgcagacagcccggctctaccttcaagataatcggctgctatgctgctgctctcgatgcaggcggcaaaacacttgcatctgtgcaggatgatgcaccgtttacagtaggttcaaaaacctttaacaactatgacaaatctttcggaggctttacctccatccgatgggcaataacaaagtccatcaatattgtaacagtcaaaaccttacaggatatcggggttgagctcggttacaaatatgcggaggatttcggtatttcaactctcaccgattccgacaaaaacctgtcactggcgctcggcggactgacaaagggtgtcacaaaccttgagctcacaggtgcatatgctactatagccaacggcggagtatacttagagccaaagttctacactcaggttcttgaccacgatggcaatgtattacttgacaagaccaatacacaggacacacgtactgtaatcaaggatactacggcatggcttcttacagatgccatgaaggatgttctgacacagggaaccggaaagctggcgcgctttgacagccagatagcccaggcgggtaaatccggtaccacaaccagcaaccgcgactgcctgtgggcaggctacacaccatactacacatgtgtcgtatggggcggctatgatgacaactcaaaacagtccggcaagctcacatcctaccctaagaatatatggaggaatgccatgagcagaatccatgaaggacttgaaaccaaagactttgtacagccggatggtataacaaataccacggtatgcagcaaatcaggacttgttcctttagagggaacatgtgacaatgatcctcgaggatcaatgctgacaaccgaatattttgatacggacactgtgccgacagacagctgcgaccatcatgttgcacttgagatttgtgccgattcgggagccattgccggtccgtattgtccgaataaaacatcaaaggtatttataacaggcgctgtatcaggcagccctgagtatgaattcatggcagatgatacgttcatgaataccgtatgtacattacatgatgcaacatcgctgattaacagctcaccaaccaccacggatcctaccaattccggtactacaccgggcagtactgacggcactgcggctggagcacagacaggtggggctggaactggtaccggtgctggctcaggtgctggtactggcactggcggttccggagccggtgcttccggtaccggtggctcaggttcaggtggtactgatactggcagctccggttcatccggtaacactcatcgttaaccattacgattcacaacttaattatctaaagcaaaacccccaaggatcatatcctcgggggtttttgttgatgtatatatactaggggattagataataatttgcattactctacatcctgtaatgcctcaattccttcctcgcctgtacgaaccttgacaacctgtgccacgtcgtaaacgaagatcttgccatctccgatatgtccggtgtagagagtcttcttagcagtctcaataaccttttctaccggaatcttgccaacgattacctcaaccttaacctttggaagtaatgtcgcatcaagctcagctccacggtatttctcgccggcacccttctggataccacagcccataacctgtgtcactgtcattcctgttacacctaagtcattcatagccttacgaagcttgtcgtactttgtaagctttgaaataataacaaccttgtggataccgcttgctgaagccggtgttgttgcatttacaacaggcactgctgcatccttctttgcctgagaagctgttgcatactcagaagaaccaaggtctgtattttcattgacatccataacatcacctgatacatccatgatagcaaatcctgcatatgctgatggaagaccatgctctgttgggtcaagtcctacgatttcctcttcctctgaaactctaagtcccagtgtagccttgataacaaggaatacgattgtaatagttactactgtccatgctgcaacagacacaaagcctgtgagctggagtcctaaaagcttaaatccaccgccgtagaaaagtcctacgagctcgttgccctttgtatcagcgattgaatatcccggagcactgtttgtggcaaaaagaccaacagcaattgttccccagataccattcatcatatgtactgcgacagcacctacagggtcatcaacacgaagtacattgtcaaggaaccatacaccgaagcagacgagaagtcctgctacggaaccgataatgatagcaccaagtgcatctgttacatcacagcctgctgtgatagctacaagtcctgcaagtgaagcattcagacacattgacacatcaggcttgccatatttgagccatgtgaaaatcatacaaactactgttgcaagtgcaggtgcgattgttgttgttacaaagatagaaccaagctgctctactgattttgctgctgcaccgttgaatccataccagccaagccagagaatgaatacaccgagtgcaccgattgtgatgttatgacccggaatagcgtttacctttgtaatctttccgtttttatcctttgtaaactttccgatacgaggtccaagaattgcagctcctacaagagcactgataccaccaaccatgtggatggcacatgaacctgcgaaatcatggaagccaatctgtgaaagccagccaccgccccagatccagtgagcctcgattgggtaaataagtgctgaaataactcctgaataaacacagtaggaaataaattttgttctctcagccatagctcctgatacgatagttgctgttgtcgcacagaaaaccaggttgaatacaaagtttgaccagtcaaaatctttgtaagatgtaaagatgtcaaatcccggtttaccgatgaagccaagaacatcttcacctaataaaagtgaaaaaccaatcagtatgaatacaactgtaccaatacaaaaatccatgaggtttttcataaggatgttaccggtattctttgctctggtaaaacctgcttctaccatagcaaaacctgcctgcatccagaataccaatgctgctccaataaggaaccagactccgaaaattactccactaatctcttctgtcatagtaatgtcctctctttcctgtttcttctttcattttttcattttatcgaaaataaaatttataaaaaaatagagacacttcaccaatttccacagcttcgtggttcagcaaaatgtctccattttattattatgttaaattaaatcatatatgccgctctaaacagctttctgtaagctttgggccttaaactacaaggattaaacctcgaagattaaatcgccgtatgatggcattggccacatctctttatcgacaatcatctcaagctcatcaaccggagtacgaagagcatccatagcagtctttacaacatctctgtagtaaacagcctgctctctgccctcttccatagcaccggcctttgctgtctcatccttaagctttgcaagtgcaacctgtgcatctgagagaagagctgagctctctgtaagaagctctgactgaacagatacatctgcatcagcaactgcactcttaactgagttaactgactgtgcaagtgatgtaatatacttgataactgcaggaataatctgctttccggcaatatcaatcatagcctttgcttctatattaatagtctttgcatatgtctcatactcgatctcggcacggctctcaagctctgtctttgtaaatacaccgaacttctcgaatgctgcaactgactcaggagcaacgtatgcaggaattgcatctaccatagacttgatgtttggaagtccacgtctctctgcctcagctacccactcatctgagtatccgtttccgttgaatacaattctctggtgctctactgcgtaatccttgatgagatcatgtacagcgaggtcaaagttgtctgccttctcaagtatatcacaagcgtctgagaatgcctcagccacgattgtgttgagcacgatgttggcctgtgcaacagaatcctgtgaaccaaccatacggaactcaaacttgtttcctgtgaatgcgaatggcgatgtacggttacggtctgtagcatccttcatgaaatcaggaattgtcttaacacctgtctcaagcttctcaccctttaagctgtgtgtagctgtacctgttgcgataagctggttcaatacgtctccgagctggtctccaaggtagatagaaaggattgcaggtggtgcctcgttagctccaagtctgtgatcgtttcctacatctgctgctgccgcacgaagaagtgctgcatgctcgtcgattgcctttaacatacatgtgagtacaagtaagaactgcacattgtcatgtggtgtcttgccaggctcaagcatgttgataccatcatctgttgtgattgaccagttgtcatgctttcctgaaccgttaactcctgcgaatggcttctcatgaagtaagcactggagtccgtgacggcctgccaccttcttaagtgtctccatgataagctggttgtggtcaacagctacgttgcactcagcatagataggtgcaagctcgtgctgtgcaggtgctacctcgttgtgctgtgtcttagctgaaacaccaagcttccagagctccttgtttacatctctcatgtaagctgcgattctctcacggatagctccgaaataatgatcatccatctcctgtccctttggaggcatagctccgaaaagtgtacgtcctgtgaagatgagatcctttctctgtaaatacttctcacgatctacgatgaagtactcctgctcaggtccgacagaaggtgtaaccttctttgatgttgtatttccgaataatctaagaagtctcagtgcctgatcattgattgcttccattgatctaagaagaggtgtcttctgatcaagagcctcgcctgtgtatgaacagaaggctgttggaatgcaaagtgttgcgcctgctgcatcctgtctgacaaatgcaggtgatgtacaatcccaggctgtatatcctcttgcctcaaatgtagcacgaagaccacctgatgggaaagatgaagcatccggctcaccctttattaactcttttcctgaaaagctcataagtacttttccgtttggcattggagaagtgataaatgaatcatgcttctcagcagtaacgcctgtaagtggctggaaccaatgtgtatagtgtgttgcacccttctcaatggcccattccttcatctcgtgtgcgataacatcagcagtctcgagatcaagctcctttccttcgtccataacctcatggagcttcttgtaaaccttctttggaagacgctcctgcataactgcatcgttaaatacgttctctccaaagatgtctgctacgttgaaatattcctgttcgctcatatcttacatcctttctgttcatcaatccccttgagtgaattgttattttcaaataatgtttaaacagctgcacaacatataaactcgaatattcttgttttatgccggacttcttagtttattaaaaaagagggcactccatctatggtggaacgccctcgttcatttcgcttaacattatttctgaaattaagatactcctttgagtatcaaaaatcaagtgtttatgttaaaaaagttaagttttataaaattttactacaagatataaatattttgtaaagtagtatgtgcaaaaatactaaattgcaataatattattcagcctttccaactgatccgaaaagctccatcttctccttaactgttgccttgattgcctcagcaccaggagcaagaagcttacgagggtcaaatcccttgccctcaagatcctttccggcctcgatgtatttacgtgttgcatctgcgaatgaaagctggcactctgtgttaacgttgatcttagatactccaaggtcgattgctttcttaatcatgtcagccgggattcctgtaccaccgtgaagtactaatggcataacacctgtcttctgctggatagcatcaagagtctcaaagctaagtcccttccagtttgctggatattttccgtgaatgtttccgattcctgctgcaagcatatctacaccaagatcagcaactctcttgcactcgtcaggatcagcgcactcgcccattccaacaactccgtcttcctcgccaccgattgaaccaacttcagcctcgatagacatgcccattgcatgagcaactgttactaactcttttgtctttgcaacgttctcatcgattggataatgagatccgtcgaacatgattgatgtgaagccggccttaatgcacttgtagcatccttcgtatgtgccgtgatcaaggtgaagtgctacaggtactgtgataccgagctcgtcatgcatagccttaaccattgctgctactgtaccgaagcctgtcatgtactttccggcaccctcagatacaccaaggattacagggctcttaagctcctctgctgttaaaagtattgattttgtccactcaaggttgttgatgttgaactgacctactgcgtaatgtccttcttttgctttcttaagcatttctgttgcagatactaacatattttttcctcctgttaattaaaagctaatgttattatattacataaccttataaaaataaagttaaatttttaacacaatcagacaaaaaattgtgtactattactattttatgtccgattttgtatttatcagcacataatggtaatctgtttgttcagattagtgatggtcagatccgtgtggctgccaccaaactctccgtcgagtgtccacggtacctcctcctcactctccacatgcagctcactggtcttgaaggagtagatgagctcattgtcattttcacggtttgccagtcccgcaagtatcttgttgagctcgattgggttttttggattcttgatgagtgtcacctcgaaaaggccatcgtcaagcagtacgtcaggacctgatatgcccttgaagcctcctaccgaaagggagttggtcaccattccatatataaactcatcctctattatctcaccgtcatggctcaccttcatcctgtacgaggtgatatccatcaggtgctttgcaccctctaaaatatatgcggcgtgtcccagtatatttttcatctgctgcgaggtctggtaggatacctctgtaaaaaggccaaaggctgcaacatatacgaaggtatctccgttgaagcctcccacatcacatgggaatggagtaccgtttacggcaactcttgcggcctcctccatattttttggtatgccgagagagtttgcaaagtcattggtgctgcccgcagggatgtatcctatcggtacatttacctcgctttgctccatgccggtcactacctcgtcgagtgtgccgtctccgccgctgcacactacaaggtcatacttctcagcatttttcctgaccttttttatggcatctccctgacactgtgtaggataaatggtgattttgtatccggcctttgtcatgatgtccacgatatttacaaggtgctcctttatgagtcccttgcctgatttgggattaaatacaaataaaagctttttcttcatctatctcagttcctccgcaatcgccgataattttctaagcctgtggttgactcccgatttgcccattggcggatccagatatcctccgagctcctttagcggtgcatccggatattcaagccgaagcagcgccatctcccgaagctgcgcgggtaaatcatcgagtcctctcattttctgtatcagtctgatatcctctatctgctttactgccgcattcacagtcttgctgatgtttgcggtttcgcagtttactttacggtttacactgttgcgcatttcctttaatatacgcacattttccagcttcatgagtgacacatacgcctccatgatgttgagactgtccacgatgtgggcgccctcctttatgtacactacatagtgccccttgcgctctactatcttggcatccgtatcaaagccgcacaagagctcctgaagctgctttgcctgctctttcgtatgacacactatctcaaaatggtacgctttgttggggtcgcttatcgagcctgctgccatgaaggctcccctgataaaggctctcttgcagcatgtctgcataagaagcagtccgtctgcggtctgtctgttgacaggctgtgccgtgattttaagcgctgcaagtatttttccggtatcctgctcatccagcgcctttgtggtatctgtgccaaaggcgcgcttcataagtgtggcatatttatttaaaagcagcaggttttcggtgtcgagctcaagtccctttgttttttcattgatacggcccgaaagctctatgatgcctgcaagctcagcgagctgacagtgcctgctctttgatacctgctttgccagctcttcctttacatcactggaaaatgacatgttatttacctctcaatgcatcctttcctatgtcgcgatgctctatcttaagtccatagtcattacagccgctaagcctcttgtacagctcgtttgcaagcgttaccgagcggtgcttgcctccggaaactgcatgacatagtcctgtatctccttatcattgccggttttcgcgcgtagtccgtccacatagtagggatttggcagaaacctcacatccatgactatatcagagtctgacggtatgccatacttgaagccgaaggacagtatcgtgataaacagatttttgtaatcctcattctgcacaaatatcttttccagctcaattttaagctcccttgtgagaagctggcttgtgtctatgatatagtcagcattgtcctttaaatactgcagcttttccctctcaagcacgatgcccttattgatgcgctcactgcctgcgagaggatggtttcgcctcgtctccttgtatcgctttacaagcacctcatcctcagcatcgaggaaaagtatctcatacggaaaatttttctgccttagctgctcgagcgtctgtggaatcgcatcaattcctgaaccgtttcgcacatctatgccgactgccaccttggacacatcactgtggaaggtatttgaaaagtctatgagcttatctaatagctgtataggcagattgtctatacaaaaatatcccatatcctccatcattttcattgctgtgctttttccggcacctgacatgcccgtcactattacaaatttcactagaattctccaatcatcttaacttccggttcgagctttactccaaactgctttaaaactgtttcctgcacgtcttttatgagtgtcaggacatccgctgcagtggcttcgcccttattgactacaaagccgcagtgcttctgagacacctgtgcatctcccacgctgtaacctcgaaggcctgcatccatgataagcttccctgcaaaatagccctccggtctcttaaaggtgctgcctgcacttgggtactcaagcggctgcttctccactctctttgcgcgaagctctgccatatatgactttatctcatccttaggctttggtgtgagcctgaatctggctgacagcactatatagcccttttcctggactatactgtgcctgtaggataagtcaagctcatcccttgtgacagtctttagctcgccctctgctgtgagcactgtggcatcgattaggacatcctttatctctccaccgtaggctcctgcgttcatgactaccgcgcctccaacacttccgggtatgcccgatgcaaactcaagacctgaaagcgatgcctccgctgcctttgccgccactgctgcaaggatagccccggcgccggctgtgatgatatgaccgttgtcttgtgctgtgaggtcctgcgctgtgctttgctgcgccacagcttctgtcacatcgatttcggacaggccttttccaataccaattacaaggcctctgatgcccttatctcctaccagcagattgcttccgtttcctatcactgtaaccggcatatcacatgccttagccatctctataagctttgaaatttgactcatatcaggctctgcatagtaatctgccgagcctcctatgcggaatgtcgtgtgttttttcatcggctcatcctgcaggagaccaagctgcggcaattgttctgttacactttttacaaatgtctgattcatcttatattcctttagcctatgcttccttcaaaaatgcaatgtagcctctgaatgcctcatataaatcgaccttgctgatgatttcccatggcgcatgcatattgagcaccggcacaccgctatcaataacattcatgtcatagtttgcgaggatatatgcgattgttccgccgcctccctcgtctacctttccaagctctgctgtctggaatgaaacatctgctgtatccatgatatttctaagccttgcaacatactctgcgttggcatcgtttgagcctgatttgcctctggcgcctgtatatttgttgaatacaagaccctttccgaagtatgccgagttcttcttttccataaccgatggatagttcgggtcaaaggctgctgatacgtctgatgagagtacctttgagtttttcagtgcacgtctgactgcaagctcgctgtagtctcctgccaggttcatcacctctgccacacagttttcgaaaaagcgtgactgcatgccgctggctcccactgagccgatttcctctttgtccacgagcaggcatacacttgtatattccggtgcgccctctatttcaagcatagctctgtatgaaggatatgcgcacactctgtcgtcgtggccgtaacccatgatcatacttctgtcaagtccgtagtctcttgcctctccggcaggtaccacctctatctctgctgaaaggaaatcatcctcgtccacaccgtactcctgtgaaagtattgtgaggatattggcctttactctctccttgatatccttgtcgtcctcgtccttttctggtcccggtatgcttccgatcagcacatcaaggctctcgccctttatgacctctgaggccttcttgcccatctgctcgcctgacaggtgaataagcagatcgctcacacccactacaggatcatttggcttgtctccgatattgactgtcactgtgctgccatcctttttacagatgactccgtgaagtgcaagcggcagtgtgacccactggtatttcttgataccgccataataatgtgtgtctaaaagtgccatgtctgtgtcctcgtataaaggcacctgctttaagtccattctaggtgaatcaatatgtgctccgaggatattcatacccttctcaagaggcttactgcccacgataaacagcgccagtccctttcccatattgtttgctatgattttatctcctgcctttacgctctttcctgtctcgatgagctcatcaaggtctacaaagccgtgtcctgtggcgtcagcataaactgatgccgtgcactcgcgctctgtcttgcagccggatataaaccttctgtaatcctctgcaaatgcaaataatttttctctttcaggtccctggggatatttctcccaggcgtttttcttttctattgccatgatttattatacctccgaattttttgtaagatttgcctggacgcggcgatacagctcctgagctgcattgtagcccatctttttttgtctgtgattgactgctgctgtctctacgatgactgccagattacgtcccggtctgattggcagtgaatgacacactaccttgttgccgagatactcggcatattcttcctcgaggccgagtctgtcgtaatctgcctccttcttccagtcctcgagcttgattacgaggtctatctgctgtttttcctttacacactctactccgtaaagtgtcttgacatcgatgattccgatgccacgaagctctataaagtgtctggtaatctcaggcgaagtacccatgagcgtatgctcgttgatctttctgatttccaccacatcatccgtcacaagacgatgtcctcgtctgatgagctcgagtgcagcctcactctttccgataccgctctcgcctgtgatcattactccctcgccgtatacatctaccagcacgccgtgcactgtgatgcatggtgcgagctgctcaccaagacaatagatgagctcagccataaagcttgatgtggaacgacctgttgacagcaccggaataccgtgctctctggcctcttccataaatatctcatccggctgtaaatctctgcagaagatgatacatggtatatcaaactccatgaagcggctatagcgctcttttttctcgctgtcgctcatcttctctatataggtatactctacatttccgataatctgtattcgtctctcctcaaaatgatcaaaatatcctgagagctgaagcgccggtctgttgacgtccgagcactctatcgccctctcctttaggttcatctcttttgtgagattgttgagatcgagcaattctgctacctttgcaactgatactgagtgtaatgcatccattcgcggtcccccttgatgtatatttgttttttagtataccacagattagcttcaaaatctacgtggcagagtggaaaaatgcatacactgcctgtgctgctttttcgttcatggtctctgtctgcataaggtcttcgacatctgcttcctttatcttctctagcgactggtaacggcgcataagcgcctttctgcgtgccggccctatgccttcaatatcatcaagcaccgaatgtacctgactctttgagcgcagtgacctatgaaactctattgcaaagcggtgtgcctcatcctgtattctcgtgatgagcttgaagccttcgccgtggcggtcgataggtatctccacattgttgtaataaagacctcttgtgcggtggaaatcatccttcaccatgccacacacaggtatgtcgagtcccagctcagaaagcacctgaaggcatatatttacctgacctcttccaccatccatcattataatatccggaaaacggttgaagctacctatttcctgtggagaaccatctttttcaagctgcttctgttcttccatgccatgtgtaaagcggcgtgtgagcacctcgtgcattgacgcataatcatcaggtcccgtaactgtgcgtagcttaaactttctgtaatcgctctttttaggcttgcccttctcatacactatcatggagccgacggtctcaaagccgttgatattggaaatatcataggcctccatacgatttaatccatgtaagcccaaaagtccctcgatttcctttacagctcctattgtgcgcccctcttctctctttatccgctccttatcctggctgagcactaagagtgcgttcttataggcaagctcaacaagcttttccttcatgcccttctgcggcacttttatattcacccgcctgcctcgcttttcgctgagccactgctccaaaacagccatatcctctatctcgctctgcagcatgacctcgcgcggtataaaaggtgttccggaataaaactgcttcacaaagttatttaacacatcatccgcagcctcctcgcttccaaccctcacatggaaatggtctctgcctatcagctttccgtttcttatgaaaaatacctgcactactgcatcagtatcgtcatttgcaagtgctatgatatccttatcctcgccgtcggcatttgttatcttctgcttctgcgctacctgtttcacactgtttatcaaatccctgtattcagccgccttctcaaactccatgctctctgaagcctttagcattttatcgctaagagcctttattgtctgctcatagtcgccgtttaagaaatctatcgcgccctttacagatatagcatactcttccttcgtcacatacccctggcatggtgcattgcactggtgtatatgatagttgaggcacggccggtctgctcctatatcacgcggcagcctgcggttgcaggtgcgaagcttatagattttgtttatcagatctatcgagcttttcaccgcagaggcactcgtatacggaccaaagtaacgggatttgtcctttttcatctgacgcgaaaacagcaccctcggatagtcctctcccagtgtcaccttgatgtacggatatgtcttgtcatcacgaagcatagtattgtactttggtgtatgctcctttatcaggttgcactccaaaacaagggcctcaagttcagagtcggtgactatatactcaaaatgatctatatgctctaccatctgttttttcttgatgccctcattgtggctcgcctgaaagtactgatgtactcgcttcgtcaggcttttggctttgccgatatatatgattacatcatccttgtcatgcataatataaactcccggggcatccgggagtttttttaattcttctttgatatcaaatgttttttccatattcgctcttttgggttgttgtggagtttcgcaccttcaggttgtgaagttgccggcatggcacacagtgtattcctccggcttttttcagtttatgtgtgcgaaactcttttctactgcgctttttttgtgcgaaattcttttttcgctctttcgctgcgcgaaaattgcttgattgctcgttgtgttcgaaaattgacctataaggtactagttattcaatgtattatcatccggcgctgtatattcggaagattcatttgtatctgcaggttggtctgtggcgttacgaaggagtggatctgctgctgatgtcgtatctttctgtgcatcattctgtgcattttcatgttctttgctctcttcaccatctttttcctcgtccgggtcagggagtcccttcatatcgcggaacatcttcatgaattccttacctgtgattgtttccttctcgtagagataatctgatatactgtcgaggatttctctgttttcatcgaggagcttcatggcctctgcgtagctgctgtttatgattgagagtacctcatcatctatctgcgatgctgtattctctccgcagattaatcctgctccgccctctaagtactggttttgtactgttgcaaggcacatcatgccgaatttatctgacattccgtacatagttaccatggcacgggctatctttgtggcattttctatatcatttgcggctccgcttgtgactgagttaaataccagcacctctgctgcacgacctgccatatatgttgtgattttggcgagaagttcatcctttgtctcaaggtatttctcctcttcaggtgtctggagtgtatatccgagtgcgcccatggtacgtggtacgattgtgattttctgtacaggctctgtgtttttctgcagggctgatacaagtgcatgtccaacctcatggtatgagacgatttttctctctttatcgctcatgacacgatccttcttttccttgccaccgactgctacaagctcgaaggcctcaaagagatctgactggtttacaagctgtctgccgtttttgactgcattgatggcagcctcattaatcatattggcaaggtctgagcccacaagtcctgctgtggcaagtgccagtgcatcaaggtctaccgactcatccatcttgacatcctttgagtgtacctttaaggtctccagacgtccctttaagtcaggcttgtcaacaatgattcttctgtcaaaacgtcccggacgaagaagtgccttatcaagcacctcagggcggttagttgctgctaatataagtaatccttttgatgtatcaaagccatccatctctgcaaggagctggtttaatgtctgctcacgctcgtcattgccaccgccgtatctgctgtcacggctctttcctattgcatctatctcatcgataaagataatacatggtgccatcttttgtgcttccttgaacaaatcacgcactctcgaagctccgactccgacaaacatctccacaaagtctgaacctgcaagtgagaaaaacggtactcctgcctctcctgctactgccttggcaaggagtgtcttacctgttcccggaggtcccacgagaagcgctcccttaggaagcttggctccgatatctgtatatctcttaggattgtgaaggaaatcaacaacctcctggagagattccttggcttcatcctgtcccgcaacatccttgaagttgacgcctgtggacttctccacatataccttggcagtcgatttgccgactcccatccccatgctgccgcccatcttctttgaaacaaatgccaaaagcacccacagtaaaataagcggaactataaagcttaatatattaaaaatccatgtagatgtattatcaggtatcgctgcctttatctcaatagacttgccctctgaggtctttgcttttttgagtgtcggcacaagctcatcatcagccacacggcctgtgtaatatgtgatgtcataatccttgtgtccgtcatccacaagcttgtagtctatctcgtaggaatcaaactccacgctcttgacattacccttatcaagctgttttatgaaatcactgtatgacttttcctgtgtgctggcatgcgatatgctgtttgatataagtgcatacacaaacaatgccacgagtgtcagcaggataaatgccatgataccctgtccgccacggttgtttctgccaccgtttccaccaggtctgttaccaccgttatttccgtttccaccggacccattattgcccgggccattgttgtaattatagttattaggtccctgattatccatattttctccgttcttttcttatttattacaagcttcaaggcaattttgacctgtaatttttatagtcattcccatgaaaccctatccccgaaaaatatcattacagacttcttattttccaaggaatatattgtatatgaaaccgtctcctcaccatatataaagtgtgaagcttcactttattataagaaaaagtgcggtcaaaatcaaccgcactttctaaatattgtattaaatataacgaaaaattatctgttcaccttgtttgccgcctctatgaaaccatggaaaagcggatgtggacggttcggacgtgacttaagctcaggatgtgcctgtgtggcaataaaccacggatgctccggaatctcaatcatctccacgattctgccatccggtgatgtaccgcaaagcttcatgccatgctctgtgagagctgttctgtagtcattgttgacctcataacggtgacgatgacgctcgcttatattctctgtgccatatacctgatatgcctttgatgtcttgtcgagtacacatggataagagccaagtctaagtgtacctccgatatcctctattccgttctggtcaggcataagtgcgataaccggatgagtagtgtttggatcaagctctatactgtgtgcatcatggaacatacatacgtggcgcgcatactcgatgattgccacctgcattccaaggcagagtcccagatatgggatattgttttccctggcatacttagctgctgcaatcatgccctcaacaccacggtctccaaagcctcccggaacgataattccctgaatgcccttgaatacctctgctgcattgtcatcattaagttcctctgagtcaacccactttatatcaactgtggtatgctcaggaataccgccatgcttcagtgcctcaacaactgaaatgtatgcatcgtgaagtgctgtatattttccgacaagtgcgatcttgacctctttatcaggatgacggagatcctcaaccatctgcttccagtctgcaagatccggctcaggacagtcgagattcaagcactcgcatgcaacctttgcaagattctcctgctccatggcaagtggtgcctcatagagatactccacatcaaggttctgtaatacatgtgaattcggtacattacaaaacagcgcaatcttgtccttaagcttctggtcaagctcatgctctgaacggcatacaatgatatccggctggattcccatgccctgaagctcctttacgctggcctgtgtaggctttgtcttgagctctcctgacgccttgatgtatggaatcagtgtcacatgacacaggatggcattgtcgtgtcccacctcatgctggaactgtctgattgcctcgaggaacggctgactctcgatatcgccgactgtaccgcccacctcgatgattgcgattgtggtatcctcagatgtgaaatccctgtagaatctgctctttatctcattggtgatatgagggataacctgtactgttcctccaccgtagtcaccacgacgttccttctgtaatactgaccagtatacctttcctgtggtgacgtttgagttctttgtcaggctctcatcaataaaacgctcatagtgtcccagatcaagatctgtctcagctccatcgtctgttacaaacacctctccgtgctgaatagggttcatggtacccggatcaatattaatgtatggatcgaacttctgcattgtcaccttgtatccacgagcttttaaaagacgtccaagagacgctgcggtaattccttttccaagaccggaaacaactccaccggtgacgaacacgtattttacaggcataattttcctccttatcaatatgctttgtatatttgtaaattcttaatttttaaaataaccaacttattatacagccttaaattgattaatgcaatttattttttaattatatttattatattttgttataatgcttcacatctggtgacggacaaccctgtattcatcgcctgagcggtaaaacggacagcgcttatagctgctctggacaaatctcgccatatcatcctcgtccatatttaccgagcaataatactcctcatcatcctcatcatattcattgtatgcacaaaaatcgcagcatgtctccattatcttatcct
